United States Patent 11,098,302 (IDENTIFICATION OF POLYNUCLEOTIDES ASSOCIATED WITH A SAMPLE) - sequence listing, part 100

SEQ ID NO: 344175 - DNA, 513 bp, Homo sapiens
  misc_feature: GZ8MTXP02JYO38.10.28.C06.1.454.CMB.2.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (487)..(487): a, c, t, g, unknown or other
  misc_feature (487)..(487): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttangatgtcagtaatcgacctnaggggtttcngatcgcttcttcgcctcagtctggcacncgcctcctgaccatctcngggctcagctgaggcgaggctgattattactgcagctcacatacaagcgcagcggttgggtgttcgggcgggggaccacgacgtgaccgtcctaggtcacgccaaggcncgcccctcggtcactctcgttccccg

SEQ ID NO: 344176 - DNA, 527 bp, Homo sapiens
  misc_feature: GZ8MTXP02GPRWN.10.28.C06.1.454.CMB.2.raw
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
tcagcatagtagtgcacgaccggtgctcgatttagagctcacgtattgggtttggggggtctcaggaggcgcccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaaactgatgatttatgatgtcagtaatcgaccctcaggggtttcngatcgctttcttgcctccaagtctggcaacncggctccctgaccatctctgggctccagactgaggacgagctgattattactgcagctcacatacaagcgcagcggttgggtgttcgggcgggggaccacgacgtgaccgtcgtacggtcgacgccaaggctcgccccgtcggccacgtcctcgttccccc

SEQ ID NO: 344177 - DNA, 566 bp, Homo sapiens
  misc_feature: GZ8MTXP02IMRRG.10.28.C06.1.454.CMB.2.raw
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagcatagtagtgcacgaccggtgctcgatttagagctcacgtattgggtttgggggggtctcaggaggcgcccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctctggtaccaacngtaccaggcaaacgcccccaaactgatgatttangatgtcagtaatcgaccctgtaggggtttcngtatcgtctttctttcgcctccaagtctggacaacncggcctccctgaccatcnctgggctcagactgaggacgaggctagtattatactgacagctacacatacgaagcgacaggtcgggttggggtgggttcggggacgggggaccacgtacgtacggaccggttacctacgggtacacggccgaaacggccgtccgcccccgtcggtacaccttccgtaccgtttccccc

SEQ ID NO: 344178 - DNA, 514 bp, Homo sapiens
  misc_feature: GZ8MTXP02GV5VK.10.28.C06.1.454.CMB.2.raw
  modified_base (366)..(366): a, c, t, g, unknown or other
  misc_feature (366)..(366): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctgggtggagtcggggggaggcttggtacagcctgggggtccctgagactctcctgtgtagcgtctggattcacattcagtagttatagcatgaactggtccgcaggctccgaggggaaggggctggagtgggttcatatatgatagaaatagnggaccatatactatgcagactctgtgaggggcattcacatctccagagacaatgaccaggtaattcactgtatgtaggaaatgaacagtctgagagccgaggacacggctctctattaactgtcgacgagacgacccgaaaagtacgg

SEQ ID NO: 344179 - DNA, 528 bp, Homo sapiens
  misc_feature: GZ8MTXP02JM27R.10.28.C06.1.454.CMB.2.raw
  modified_base (360)..(360): a, c, t, g, unknown or other
  misc_feature (360)..(360): n is a, c, g, or t
tcagcatagtagtgcacgaccggtgctcgatttagagctcacgtattgggtttgggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaatgatgatttatgatgtcagtaatcgacctcaggggtttctgatcgcttctttgcctcaagtctggcaacncggcctcctgacccatctctgggctccagactgaggacgaggctgattattactgtcagctcacatacaagcgcgagtcgggttgggtggttcgggcgggggaccacgactcggaccgtccgtacggtcacgccaaggcgtcgcccctcggtccactcctcgttcccc

SEQ ID NO: 344180 - DNA, 525 bp, Homo sapiens
  misc_feature: GZ8MTXP02I64XY.10.28.C06.1.454.CMB.2.raw
  modified_base (321)..(321): a, c, t, g, unknown or other
  misc_feature (321)..(321): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcatccgtgtctgggtctcctggacagtccatcaccatctcctgcactggacccacagttacattggtaataatgaatatgtctcctggtaccaacagtacccaggcaaagcccccaaatgatgatttatgatgtcagtaatcgaccctnaggggtttctgatcgcttctttgcctcaagtctggcacacggcctcctgaccatctctgggctccagactgagacgaggctgattattactgcagctcacatacaagcggcaggcggttgggtgttcgggcgggggaccacgacgtcggaccgtccgtaggtcacgcccgaaggcctcgccccctcggtccaccttcttcccgg

SEQ ID NO: 344181 - DNA, 523 bp, Homo sapiens
  misc_feature: GZ8MTXP02GS1C6.10.28.C06.1.454.CMB.2.raw
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctnaggggtttctgatcgcttctttgcctcaagtctggcaacncggcctccctgaccatctctgggctccagactgaggacgaggctgattatactgnagctcacatacagcgnagcggttgggtggttcgggcgggggaccacgacgtgaccgtctacggtcacgcccaaggctcgccccctcggtcactctcgttccccc

SEQ ID NO: 344182 - DNA, 512 bp, Homo sapiens
  misc_feature: GZ8MTXP02H97OG.10.28.C06.1.454.CMB.2.raw
  modified_base (305)..(305): a, c, t, g, unknown or other
  misc_feature (305)..(305): n is a, c, g, or t
  modified_base (453)..(453): a, c, t, g, unknown or other
  misc_feature (453)..(453): n is a, c, g, or t
  modified_base (481)..(481): a, c, t, g, unknown or other
  misc_feature (481)..(481): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcgggggaggcttggtacagcctgggggtccctgagactctcctgtgtagcgtctggattcacattcagtagttatagcatgaactggggtccnccaggctccgaggggaaggggctggagtgggtttcatatattgatagaaatagtggaaccatatactatgcagactctgtgaggggccattcaccatctccagagacaatgaccaggaattcactgtatgtaggaaatgaaacagtcngagagcgagaacacggctctctattacngtgcgagacgacccgaaatacggtactaacg

SEQ ID NO: 344183 - DNA, 585 bp, Homo sapiens
  misc_feature: GZ8MTXP02I2LN6.10.28.C06.1.454.CMB.2.raw
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
tcagcatagtagtgcacgaccggtgctcgatttagagctcacgtattggggtttgggggggtctcaggaggcgcccctctcgggacgtctccaccatggcctgggctctgctattcctcaccctcctcactcagggcacagggtcctgggcccagtctgccctgactcagcctgcctccgtgtctgggtctcctggacagtccatcaccatcctcctgcactcggacccacctagttacattggtaaataatgaatatgtctctggtaccaacagtacccaggacaaacgcccccaaatgatgtatttangatgactagtaatcgaccctgtaggggtttctgattcgtcttcttcgcctcaagtctgacacncgcctcncgaccntctctggcctcagtacngaggacgagctagtattattactgacagtctacacactaacgaagcggacgacggtcgggttggggtcgggttaccggggaccgggggtaccaacgtacgtaccggaccgtacgtacggtcgaccgacccgaacggccgtcccgcccccgtacggtcctacccttccgtccctttacccccc

SEQ ID NO: 344184 - DNA, 538 bp, Homo sapiens
  misc_feature: GZ8MTXP02JMZ7M.10.28.C06.1.454.CMB.2.raw
  modified_base (362)..(362): a, c, t, g, unknown or other
  misc_feature (362)..(362): n is a, c, g, or t
tcagcatagtagtgcacgaccggtgctcgatttagagctcacgtattgggtttgggggggtctcaggaggcggccctctcgggacgtctccaccatggctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaacgcccccaaatgatgatttatgatgtcagtaatcgaccctcgaggggtttctgatcgcttcttcgcctcaagtctggcacncgcctcctgaccatctctgggctcagctgaggacgagctgattatactgcagtctacacatacaaagcggacaggtcgggttgggtcggttcggggacgggggaccacgacgtcggaccgtcgtaacggtcacggcccaagggcctcgcccccgtggccacctcgtcgttaccccc

SEQ ID NO: 344185 - DNA, 517 bp, Homo sapiens
  misc_feature: GZ8MTXP02GPDUL.10.28.C06.1.454.CMB.2.raw
  modified_base (287)..(287): a, c, t, g, unknown or other
  misc_feature (287)..(287): n is a, c, g, or t
  modified_base (382)..(382): a, c, t, g, unknown or other
  misc_feature (382)..(382): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagccccaaatgatgatttatgatgtcagtaatcgaccctnaggggtttctgatcgctttctttgcctccaagtctggcaacacggcctccctgaccccatctctgggctccagctgagacgagctgattattacngcagctcacatacaagcggcagcggttgggtggttcgggcgggggaccacgacgtcgaccgtcgtaggtcacgccaaggctcgccctcgtcactctcgtcccgccctcctccaactctactcgctcgacgcggcg

SEQ ID NO: 344186 - DNA, 533 bp, Homo sapiens
  misc_feature: GZ8MTXP02GGCUZ.10.28.C06.1.454.CMB.2.raw
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaacgcccccaaactgatgatttangatgtcagtaatcgacctgaggggtttctgatcgcttcttgcctccaagtctggcaacncggcctcctgaccatctctgggctccagactgaggacgaggctgattatactgcagctcacatacagcgcgagcgggttgggtggttcgggcgggggtaccacgacgtcgaccgtcgtacggtcgacgcccgaaggccgtcgccccgtcggtccactccgtcgttcccccg

SEQ ID NO: 344187 - DNA, 523 bp, Homo sapiens
  misc_feature: GZ8MTXP02JXA2M.10.28.C06.1.454.CMB.2.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatgttggcattataaccttgtctcctggtatcaacaacgcccagacaaagcccccanactcttgatttangaagtcagtaagcggccctgaggggtttcagtcgcttctctgcctcaagtctggcaacncggcctccctgacaatctctgggctccagctgacgacgagctgaactattactgacagctcacatacaagcgcagcggtggtggttcggcgggggaccacgcgtgaccgtcgtacggtcgacgacccaggcgtcgccccgtcggtccactctcgtaccccc

SEQ ID NO: 344188 - DNA, 588 bp, Homo sapiens
  misc_feature: GZ8MTXP02HNSVT.10.28.C06.1.454.CMB.2.raw
  modified_base (313)..(313): a, c, t, g, unknown or other
  misc_feature (313)..(313): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcttgggtacaggccgtggggggtccctggagactctcctgtgtagcgtctggattcacattcagtagttatagcatgaactgggtccncaggctcgagggagggctggagtggttcatatattgatagaaatagtagaaccatatactatgcagactctggtgaggggccgtattccacctatctccaagacgacaatcgacccaagggtaaacttctaacgttaggttaagttaggtaaaggtaaaattaggaaaacctaggttacgtagaggaacggaccggaagggtaccacgggtacttcgttactacttacgtgtaacgcggtaacgaccggaacccgtaaaagtcgggttactaacg

SEQ ID NO: 344189 - DNA, 544 bp, Homo sapiens
  misc_feature: GZ8MTXP02HTVIR.10.28.C06.1.454.CMB.2.raw
  modified_base (486)..(486): a, c, t, g, unknown or other
  misc_feature (486)..(486): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcttggtacaggccgtggggggtccctgagactctcctgtgtagcgtctggattcacattcagtagttatagcatgaactgggtccgccaggcctccgaggggaaggggctgggagttgggttcatatattgatagaaatagtagaaccatatactatacagtactcgtgtggaggggcgtattcaccatcctacagagacaatgaccaggtattcacttgtatggtagaaatgaaactgtactagagacgaccggaggacncggactcgttactactactgtgaacgtacgacgacccgaaagtacggtactacgtaac

SEQ ID NO: 344190 - DNA, 527 bp, Homo sapiens
  misc_feature: GZ8MTXP02JBXEP.10.28.C06.1.454.CMB.2.raw
  modified_base (360)..(360): a, c, t, g, unknown or other
  misc_feature (360)..(360): n is a, c, g, or t
  modified_base (427)..(427): a, c, t, g, unknown or other
  misc_feature (427)..(427): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctctggtaccacagtaccaggcaaagcccccaaatgatgatttatgatgtcagtaatcgaccctcgaggggtttctgatcgctttcttcgcctcaagtctggacacncgcctccctgaccatctctgggctcagctgagacgagctgattatatgcagctacacatacaagcgnaggcggtgggtgttcgggcgggggaccacgacgtcgaccggtcgtacggtcgacgcccgaaggcgtccgcccccgtcggtcctacgtcctcgttaccccc

SEQ ID NO: 344191 - DNA, 541 bp, Homo sapiens
  misc_feature: GZ8MTXP02JZ5YY.10.28.C06.1.454.CMB.2.raw
  modified_base (332)..(332): a, c, t, g, unknown or other
  misc_feature (332)..(332): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaacgcccccaaatgatgatttatgatgtcagtaatcgaccctgtagggtttcngatcgctttctttcgcctcaagtctggcaacncgcctccctgacntctctgggctcagactgaggacgagctgtattattactgcagctcacatacaagcgcaggcgggttgggtcggttcggggcgggggaccacgacgtgacccgtcgtacgtcgaccgtcccgaacggccgtcgcccccgtcggttccacctcgtccgttcccccg

SEQ ID NO: 344192 - DNA, 589 bp, Homo sapiens
  misc_feature: GZ8MTXP02G0S79.10.28.C06.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (427)..(427): a, c, t, g, unknown or other
  misc_feature (427)..(427): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggaataatgaatatgtctctggtaccaacagtacccaggcaaacgcccccaaactgatgatttangatgtcagtaatcgacctgtaggggtttctgatcgctttcttcgcctcaagtctggcaacnccggcctccngaccatctctagggctccagacgtgaggacgagctgattatactgacagctcanactaacgaagcgacgagtcgggttgggtcggttcgggggacgggggaccacgtacgtacggtacccgtaccgttacggtaccaccgggacccgtaaaggcccgttaccggaccccccgtttccgggtacctacccggtttccctccggttttacccccccgg

SEQ ID NO: 344193 - DNA, 530 bp, Homo sapiens
  misc_feature: GZ8MTXP02FGEWB.10.28.C06.1.454.CMB.2.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagcatagtagtgcacgaccggtgctcgatttagagctcacgtattgggtttgggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaaatatgtctcctggtaccaacagtaccccaggcaaagcccccaaactgatgatttangatgtcagtaatcgaccctnaggggtttctgatcgctttctttcgcctccaagtctggcaacncgcctccctgaccatcnctgggctcagactgagacgagctgattatactgcagctcacatacaagcgnagcggtgggngttcgggcgggggaccacgactcgaccgtccgtaggtccacgcccaaggcgtcgcccccgtcggtcaccgtctcgttccccc

SEQ ID NO: 344194 - DNA, 546 bp, Homo sapiens
  misc_feature: GZ8MTXP02HKQ9U.10.28.C06.1.454.CMB.2.raw
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagtacccaggcaaacgcccccaaactgatgatttatgatgtacagtaatcgaccctgaggggtttctgatcgcttcttcgcctcaagtctggcacncgcctcctgaccatctctcgggctcgagactgaggcgagctgattattacgngacanctacatanacgagcgacgacggtgggttcgggtcggtcggggacgggtaccacgacgtcggtaccgtcgtacgaccgacgaccgacggccgtccgcccgtcgtcctaccgtccgtaccgtcccc

SEQ ID NO: 344195 - DNA, 630 bp, Homo sapiens
  misc_feature: GZ8MTXP02J2F6S.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgcttattttagaaggtgtccggtgtgaggtgcagcgtgggtgggaggtcggggggaggcgttgggtacgaggccgtggggggtccctggagactctcctgtgtagcgtctggattcactattcagttagttatagctagtgaacgtcgggtcccgccgaggccgtaccggaggggaacggggcgtagggtaggttgggtttacagttatagttcgaattaagaaacgttaggtacggaaacctatatactaatcgacagtacgtcgtggtaggacgggggccctaagttaccaaccctatcctaccgaagaagaccaatcgaccgaaggtaactcagttagtagtaggtaagaaagttagaaactagttacgaggaaggacggaccggaacggaccgacggtctacgtacttacttacgtgtcggacggacgtacggaacccgtaaagtacggtactaacg

SEQ ID NO: 344196 - DNA, 549 bp, Homo sapiens
  misc_feature: GZ8MTXP02GHFIA.10.28.C06.1.454.CMB.2.raw
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggacaaacgcccccaaactgatgatttangatgtcagtaatcgaccctgaggggtttctgatcgtctttcttcgcctcaagtctggacaacncggcctcctgacctatctcgtcgggctccagactgaggacgagctgattatactgcagctcacatacaagcggcgaggtcgggttgggtcggttcggggcgggggaccacgacgtcggaccgtcgtacggtccgacgcccgaaggccgtcgccccgtcggtaccacgtcctcgttccccc

SEQ ID NO: 344197 - DNA, 602 bp, Homo sapiens
  misc_feature: GZ8MTXP02HGAIS.10.28.C06.1.454.CMB.2.raw
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttatgaagtcaagtaagcggccctcgtaggggtttctagtcgtcttctctcgcctccaagtctggcacnccgcctccngacatctcgtggcctcgagtctgacgacgngctagaaattacttactgacagcctacaactaataaccaaaggccgggacgagggtccggggtttagggtcggggttcggggacggggggtaacccacgtacgtcggaaacccggttccgaaggtcccacggacccgaagggccctaccgggaccccccgtcggttaccgaccttaccgttcgtttacccccc

SEQ ID NO: 344198 - DNA, 550 bp, Homo sapiens
  misc_feature: GZ8MTXP02JLVYD.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcttgggtacagccgtggggggtccctggagactctcctgtgtagcgtctggattcacattcagtagttatagcatgaactgggtccgcaggctcgaggggagggctggagtgggttcatatatgatagaaatagtgaacatatactatgcagactctgtgagggccgattcaccatctccagaagacaagtcgaccgaggaaattcacgttgtatagtaggaaaattggaaacagtctaggaagacggaccgaagaaccgacgggtactaccttcctaattacgtggtgcgaagaccggaccccgaaaagttcgggtacttaacg

SEQ ID NO: 344199 - DNA, 535 bp, Homo sapiens
  misc_feature: GZ8MTXP02HOF0F.10.28.C06.1.454.CMB.2.raw
  modified_base (269)..(269): a, c, t, g, unknown or other
  misc_feature (269)..(269): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaactgatgattangatgtcagtaatcgacctcgagggtttctgatcgcttctttgcctcaagtctggcacacgcctcctgaccccatctctgggctccagctgaggacgagctgattatactgcagctcacatacaagcgcagcggttgggtgttcgggacgggggtacacgacgtcggaccgtccgtaggtcacggcccaagggcctccggccccgtcggtcacttcctcgttccccacccttccctcctaacctactactcgctcggacgtcgggcg

SEQ ID NO: 344200 - DNA, 521 bp, Homo sapiens
  misc_feature: GZ8MTXP02JR37L.10.28.C06.1.454.CMB.2.raw
  modified_base (412)..(412): a, c, t, g, unknown or other
  misc_feature (412)..(412): n is a, c, g, or t
  modified_base (453)..(453): a, c, t, g, unknown or other
  misc_feature (453)..(453): n is a, c, g, or t
  modified_base (491)..(491): a, c, t, g, unknown or other
  misc_feature (491)..(491): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggaggtcggggggaggcttgggtacaggccgtggggggtccctgagactctcctgtgtagcgtctggattcacattcagtagttatagcatgaactgggtccgccaggctcgaggggaaggggctggagtgggttcatatatgatagaaatagtaggaaccatatactatgacagactctgtgaggggccatcacatctccaganacaatgaccaggaaattcactgtatgtaggaaaatgaaacngtactgagagccgaagacacggctctactattacgtgngcgagacgacccgaaaagtcggtactaacg

SEQ ID NO: 344201 - DNA, 612 bp, Homo sapiens
  misc_feature: GZ8MTXP02HI2T2.10.28.C06.1.454.CMB.2.raw
  modified_base (396)..(396): a, c, t, g, unknown or other
  misc_feature (396)..(396): n is a, c, g, or t
  modified_base (548)..(548): a, c, t, g, unknown or other
  misc_feature (548)..(548): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcgttgggtacaggccgtggggggtccctgagactctcctgtgtagcgtctggattcacattcagtagttatagcatgaactggggtcccgcgaggctccgagggaagggctggagttggttcatatattgatagaaatagtagaaccatatactatgacagtactcgtggnggacggggcccgtattaccgaaccctatccctaccagtaacgaacaaagtcgaccgaaggtaaacttccatgtatagaggaaatgaaactagtcgtaggaagacggaccggaaggaccgaacgggtccttaccgttacttaacgtttaccgnggttaacggaccggtaaacggaacccggaaaccccgtaaaaggttacggggttaacctaaacgg

SEQ ID NO: 344202 - DNA, 505 bp, Homo sapiens
  misc_feature: GZ8MTXP02FW8J2.10.28.C06.1.454.CMB.2.raw
  modified_base (368)..(368): a, c, t, g, unknown or other
  misc_feature (368)..(368): n is a, c, g, or t
  modified_base (445)..(445): a, c, t, g, unknown or other
  misc_feature (445)..(445): n is a, c, g, or t
  modified_base (480)..(480): a, c, t, g, unknown or other
  misc_feature (480)..(480): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaagatgtccggtgtgaggtgcagctggtggagtcggggggaggcttggtacaggccgtggggggtccctgagactctcctgtgtagcgtctggattcacattcagtagttatagcatgaactgggtccgccaggctccgagggaagggcctggagtgggtttcatatattgatagaaatagtggaaccntatactatgcagactctgtgagggcattcacatctcagagacaatgccaggaattcactgtatgtaggaaatgaacngtactgagacgccgaggacacggctctctattacngtgacgagacacccgaaaatggtac

SEQ ID NO: 344203 - DNA, 529 bp, Homo sapiens
  misc_feature: GZ8MTXP02JQK7H.10.28.C06.1.454.CMB.2.raw
  modified_base (451)..(451): a, c, t, g, unknown or other
  misc_feature (451)..(451): n is a, c, g, or t
  modified_base (494)..(494): a, c, t, g, unknown or other
  misc_feature (494)..(494): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggaattggggctgtgctgggttttccttgttgctattttagaaggtgtccggtgtgaggtgcagctggtggaggtcggggggaggcttgggtacaggccgtggggggtccctgagactctcctgtgtagcgtctggattcacattcagtagttatagcatgaactgggtcccgcaggctccgaggggaagggctggagtgggttcatatattgatagaaatagtggaaccatatactatgcagactctgtgaggggccattcacatctccagagaacatcgaccaggaacttcactgtatgtagaaatgaacngtactagagacgaccggaggaccacggtctctacgtacttacngtgacgacgacgacccgaaaagtacggtactaacg

SEQ ID NO: 344204 - DNA, 574 bp, Homo sapiens
  misc_feature: GZ8MTXP02ID0UO.10.28.C06.1.454.CMB.2.raw
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacacgtaccccaggacaaacgccccaaatgatgatttangatgtanagtaatcgaccctgtaggggtttcngtatcgtcttcttcgcctaccagtctggcaacnccgcctcctgaccatcnctggctcagactgagcgagctagatatactgcagctctatagtgtagtagtggtcgtacctttcgttacgttacgggtttcgggacgggtaacggggaccgtagggccgtacggtacccgtaccgtaacgtacctacggcccgtaaacggccgtccggtacccccgtacggtccctaccgttcccg

SEQ ID NO: 344205 - DNA, 703 bp, Homo sapiens
  misc_feature: GZ8MTXP02F4QOS.10.28.C06.1.454.CMB.2.raw
  modified_base (325)..(325): a, c, t, g, unknown or other
  misc_feature (325)..(325): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacgagggtcctgggcccagtctgccctgactcagcctgcctccgtgtctgggtctcctggacagtccatcaccatctcctgcactcgacccactagttacattaggtaaatatagaatatgtctaccgtaggtaaccaacacgtaacccgaggaccaaaaccgacccccaaaagtgatagtatttangtatgtacaagtaactccgtacctggtagggtttctgtactcgtctttcttccgtaccctacgtaagtcgtacggacccaacccgtccggtccccttacccgtacgtaaccctgttccgtcggtcgggtacctaccgaaggtaccgtaggaacggtaacgtaggtcttagttaactttattacgcgactacgtactaaccgaagtaacgtaacggaacgcccggtaggtacggggttcgggggttacggggtccgggttaccgggggaccgggacctaacgtacggtaccggacccggttacgtacggtaccaccggcccgtacggtccgtccccgtaccccgttcggtacctaccgtcccgttacccgttacccccg

SEQ ID NO: 344206 - DNA, 603 bp, Homo sapiens
  misc_feature: GZ8MTXP02H9243.10.28.C06.1.454.CMB.2.raw
  modified_base (338)..(338): a, c, t, g, unknown or other
  misc_feature (338)..(338): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagtacccaggacaaacgccccaaatgatgtatttatgatgtacagtactccgacctgtaggggtttcngattcgtcttcttccgcctacagtctgacacgcgcctcctcgacctatctcgtcggcctccgagtctggaggacgagggtctagtaattacttacgtgacacgtctacgaaactattaacgaaggccggacgtacgggtcgggggttgggttacggggttccggggacgggggaccctacggacgtcgggacccgttccgtacggtaccgaccggaccgaccgtccgcccgtcccggtcgacctccgtccgttccccgtcccccg

SEQ ID NO: 344207 - DNA, 511 bp, Homo sapiens
  misc_feature: GZ8MTXP02IW9MG.10.28.C06.1.454.CMB.2.raw
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (455)..(455): a, c, t, g, unknown or other
  misc_feature (455)..(455): n is a, c, g, or t
tcagcatagtagtgcacgaccggtgctcgatttagagctcacgtattgggtttggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagccccaaactgatgattangatgtcagtaatcgacctcaggggtttcngatcgcttcttgcctcaagtctggcaacacggcctcctgaccccatctctggctccagctgaggacgagctgattatactgcagctcacatacaagcgcagcggttgggtggttcgggcgggggtacacgacgtcgaccgtcgtaggtcacgccaaggcncgcccctcggtcactctcgtcccacctcctccaactactatcgctcgacgcggtcg

SEQ ID NO: 344208 - DNA, 517 bp, Homo sapiens
  misc_feature: GZ8MTXP02F9CST.10.28.C06.1.454.CMB.2.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (427)..(427): a, c, t, g, unknown or other
  misc_feature (427)..(427): n is a, c, g, or t
tcagcatagtagtgcacgaccggtgctcgatttagagctcacgtattgggtttgggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaaatatgtctcctggtaccaacagtacccaggcaaacgcccccaaactgatgatttangatgtcagtaatcgaccctnaggggtttctgatcgcttctttcgcctcaagtctggcaacncggcctcctgaccatctctggctccagactgagacgaggctgattatactgcagctacanatacaagcgcagcggttggtggtcggcgggggacacgactcgacgtcgtacgtcacgccaggctcgccccgtcgtcactctcgttccccg

SEQ ID NO: 344209 - DNA, 558 bp, Homo sapiens
  misc_feature: GZ8MTXP02IVQOW.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcttgggtacaggccgtggggggtccctgagactctcctgtgtagcgtctggattcacattcagtagttatagcatgaactggggtccgccaggctccgaggggaaggggctggagtgggttcatatatgatagaaatagtagaaccatatactatgacagactcgtggtggagggggcccgattacaccatctccagacgacaagtgacccaaggtaattcgaacttgtagtaggtaggaaattgaaactagtctagagcggaccgaggaccacgggctacgtctattcgtagtgacgagaaccgtacccggaaaagtacgggtacttaaacg

SEQ ID NO: 344210 - DNA, 523 bp, Homo sapiens
  misc_feature: GZ8MTXP02JTO6V.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcgggggaggcttggtacagccgtggggggtccctgagactctcctgtgtagcgtctggattcacattcagtagttatagcatgaactgggtccgccaggctccgaggggaaggggctggagttgggtttcatatatgatagaaatagtggaaccatatactatgcagactctgtgaggggccagttcacatctccagagacatgaccaggaattcactgtatagtaggaaatagaacagtactagagacgccgaggacacggctcgtacctattactgtgcgagacgaccccgaaaagtacggtactaacg

SEQ ID NO: 344211 - DNA, 600 bp, Homo sapiens
  misc_feature: GZ8MTXP02JXY7V.10.28.C06.1.454.CMB.2.raw
  modified_base (556)..(556): a, c, t, g, unknown or other
  misc_feature (556)..(556): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcgttggtacaggccgtggggggtccctggagactctcctgtgtagcgtctggattcacattcagtagttatagcatgaactggggtcccgcaggctccgaggggaagggctgggagtgggttcatatattgatagaaatagtggaaccatatactatcgacagtactacgtggtgggacgggggtaccctatttccaaccctagtccctcccaagaacgaaccaagtcgaccgaacggtaaatttcccgaattggtataggtaaggtaaaatggaaacctaggttctagaagaccgacggaacgaacgacggtctcgtaccgttattacgngtaacgacggtacgaccggaacccgaaagttacgggtactaacg

SEQ ID NO: 344212 - DNA, 529 bp, Homo sapiens
  misc_feature: GZ8MTXP02IBY3Q.10.28.C06.1.454.CMB.2.raw
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (505)..(505): a, c, t, g, unknown or other
  misc_feature (505)..(505): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagccccaaactgatgatttangatgtcagtaatcgaccctnaggggtttcngatcgcttctttgcctccaagtctggcaacaccggcctcctgaccccatctctggctccagctgaggacgagctgatttatactgcagctcacatacaagcgcaggcggttgggtggttcggggcgggggaccacgacgtcgacccgtcgtaggtcgacgcccgaaggctcgccccctcggtccactctcgttccccacccttcccnccaactactatcgctgacgcggcg

SEQ ID NO: 344213 - DNA, 520 bp, Homo sapiens
  misc_feature: GZ8MTXP02IIQNX.10.28.C06.1.454.CMB.2.raw
  modified_base (278)..(278): a, c, t, g, unknown or other
  misc_feature (278)..(278): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
tcagcatagtagtgcacgaccggtgctcgatttagagctcacgtattgggtttgggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggaggtcggggggaggcttggtacagccgtgggggtccctgagactctcctgtgtagcgtntggattcacattcagtagttatagcatgaactgggtcccnccaggctccgagggagggctggagtggttcatatatgatagaaatagtgacatanactatgcagactctgtgaggggccgattcacatctaccagagacaaatcgaccaggtaattcactgtataggtaggaaatgaacagtcagacgagccgaggacacggctactctattaacgtgtgacgagacgaccgaaaagtacgg

SEQ ID NO: 344214 - DNA, 558 bp, Homo sapiens
  misc_feature: GZ8MTXP02HL1P3.10.28.C06.1.454.CMB.2.raw
  modified_base (319)..(319): a, c, t, g, unknown or other
  misc_feature (319)..(319): n is a, c, g, or t
  modified_base (524)..(524): a, c, t, g, unknown or other
  misc_feature (524)..(524): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctgggtggaggtcggggggaggcttggtacagccgtggggggtccctgagactctcctgtgtagcgtctggattcactattcagtagttatagcatgactggtccncaggctcgaggggagggctggagtggttcatatatgatagaaatagtagaccatatactatgacagtactcgtgtggagggggccgattcgaccatctaccgagagactaatcgaccaaggtaattacacttagagtggtaggtaaaactgaaaccagtcgtaggaggacgccgaacggtacgacggcctactactagttaacgngtacgcgaacgaccgaccccggtaaaataccggg

SEQ ID NO: 344215 - DNA, 648 bp, Homo sapiens
  misc_feature: GZ8MTXP02IH58W.10.28.C06.1.454.CMB.2.raw
  modified_base (389)..(389): a, c, t, g, unknown or other
  misc_feature (389)..(389): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaggtgtccggtgtgaggtgcagctgggtggaggtcgggggaggcttgggtacagccgtgggggtccctgagactctcctgtgtagcgtctggattcactattcagtagttatagcatgaacgtgggtcccgcgaggctccgaggggaggggctggtagtgggtttcatatattgatagaatagtagaaccatatactatcgacagtactntgggtaggacgggggccctaagttcccaacctacttacctacccgaaggaacgaacctaaagtcggacctaaacgggtaaatttaccgaaacgtttaggttaagtaggttaagggaaaaagtttaggaaaccgtaaggttactaggaacggaacgaccggaaacgaaaccggacggtccttacttaccgttaaatttaccggtgtaacggacgtaacggaaccggtaaccccggtaaaagttacgggttaccgtaaacg

SEQ ID NO: 344216 - DNA, 585 bp, Homo sapiens
  misc_feature: GZ8MTXP02I4RU5.10.28.C06.1.454.CMB.2.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggtcgttgggtacaggccgtggggggtccctgagactctcctgtgtagcgtctggattcacattcagtagttanagcatgaactgggtccncaggcctcgaggggagggctggagtggttcatatatgatagaaatagtgaaccatatactatgacagactcgtgtaggacgggggtcctattccgaacctattcctcccaagacgaacaaagtcgacccaaggtaacttcattacgtagtagtaaggaaatgaaactagtctaggagtacggcccggaggaccgccggtacttcttacgttaacttacgttggtaacgacggaggaacccgaccccggtaaaagttcggggtacttaaacg

SEQ ID NO: 344217 - DNA, 552 bp, Homo sapiens
  misc_feature: GZ8MTXP02JNC5H.10.28.C06.1.454.CMB.2.raw
  modified_base (463)..(463): a, c, t, g, unknown or other
  misc_feature (463)..(463): n is a, c, g, or t
  modified_base (513)..(513): a, c, t, g, unknown or other
  misc_feature (513)..(513): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtgggaggtcggggggaggcttggtacaggccgtggggggtccctgagactctcctgtgtagcgtctggattcactattcagtagttatagcatgaactgggtccgcaggctcgaggggagggctggagtgggttcatatattgatagaaatagtgaacatatactatgacagactctggtagggagggggcccattccaccctatcctaccaagaacgacaatcgaccaggtaatcgatgtatgtagaaatgaaacngtactagaagacggacccgaaagaaccgacggtctacttactaattacgngtgacgacgaccgacccgtaaaagtcggggtactaaacg

SEQ ID NO: 344218 - DNA, 671 bp, Homo sapiens
  misc_feature: GZ8MTXP02GE68L.10.28.C06.1.454.CMB.2.raw
  modified_base (313)..(313): a, c, t, g, unknown or other
  misc_feature (313)..(313): n is a, c, g, or t
tcagcatagtagtgcacgaccggtgctcgatttagagctcacgtattgggtttgggggagctctcagagaggtgccttagccctggattccaaggcatttccacctggtgatcagcactgaacacagaggactcaccatggagttggggctgtgctgggttttccttgttgctattttagaggtgtccggtgtgaggtgcagctgggtggaggtcggggggaggcgttggtacaggccgtggggggtccctgagactctcctgtgtagcgtctggattcacattcagtagttatagcatgaacgtggggtccnccgaggcctaccgaggggaacggggcgtgggagttgggtttcagtatatgatagaaataggtaggaaaccatatactatgactagactcgtggtggacgggggtcctattccgaaccagttccaccaagaacgaacaagtcgacccgtaaagggtaaacttacctaacgttaggttaagttagtaacgggaaaattacggaaacgtaggtacgtaggaacggaacggaccgggaacggaacgtaccgggtcttaccgttaccttaaacgtttaccgttaggtcgggtaacccggaaagggtaaaccccgggtaacccccggtaaaaaaggttcgggggtttaaccctttaaaacccgg

SEQ ID NO: 344219 - DNA, 561 bp, Homo sapiens
  misc_feature: GZ8MTXP02GDGQ8.10.28.C06.1.454.CMB.2.raw
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggaggtcgggggagcgttggtacaggccgtgggggtccctgagactctcctgtgtagcgtctggattcactattcagtagttatagcatgaactgggtccncaggctcgagggaggctggagtggttnatatatgatagaaatgtagaacatatactatgacagtactcgtggtggacgggggccctattccgacctagtcctaccgaagaagaacaagtcgaacccagggtaaacttcgaactgtagtagtaaggaaattagaacgtaagtgagagacgaccggaggacacggtctacttctagttacgtgtcgacgtaacgaccgaacccgaaaagtcggggtacttaaacg

SEQ ID NO: 344220 - DNA, 569 bp, Homo sapiens
  misc_feature: GZ8MTXP02GACU1.10.28.C06.1.454.CMB.2.raw
  modified_base (289)..(289): a, c, t, g, unknown or other
  misc_feature (289)..(289): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaaggtgtccggtgtgaggtgcagctggtggaggtcggggggaggcgttggtacagccgtgggggtccctgagctctcctgtgtagcgtctggattcacattcagtagttanagcatgaactgggtccgcaggctccgaggggaggggctggaggttggttcatatatgatagaaatgtagaaccatatactatgtcagactcgtgtgacgggggtccattacacctatctccaagacgaacaatcgaccgtaaggaatttacctatagttaagtgtaagggtaaattgaaactagtctaggagacgacggaaacgaaccgacgtctactcttaacttctggtcgacggtaacgaccggaaccccgtaaaagtaccggggtactttaaaccg

SEQ ID NO: 344221 - DNA, 620 bp, Homo sapiens
  misc_feature: GZ8MTXP02GFNUW.10.28.C06.1.454.CMB.2.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcacatctcctgcactggacccaccagttacattggtaataatgaatatgtctcctggtaccaacagtacccaggacaaacgcccccaaactgatgatttatgatgtacagtaatcgaccctgaggggtttctgatcgcttcttcgcctcaagtctggaccaacgcggtcctccctgacctatctcgtcgggtcctaccaagctagggacggacgacgggcttaggtatttacgtacgtgacgagtctacaactacgtaacaaggccggtaacacgggtcggggtttggggtcggttccgggggacgggggtaaccctacgacgtacggaccccgttacgtacggtaccgaccggtcccgaaagggtcccgtcccgtcccccgtcggtacctaccttcccgttacgttaccccccc

SEQ ID NO: 344222 - DNA, 579 bp, Homo sapiens
  misc_feature: GZ8MTXP02I3PET.10.28.C06.1.454.CMB.2.raw
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgacccccaaactgatgatttatgatgtcagtaatcgaccctcgaggggtttctgatcgcttcttcgcctcagtctggccaacncggcctccctgaccntctctggctcagactgaggagaggctagattatactgacagctcgaacactacgaagtcggcgaggtcgggttaggggtcggttcggggcgggggtaaccacgacgtacggtaccgtaccgtacggtacgacggacccgaaggtcccgtcccggtacccccgttcgggtccctaccgtttccgtccgtttacccccc

SEQ ID NO: 344223 - DNA, 563 bp, Homo sapiens
  misc_feature: GZ8MTXP02F0HI5.10.28.C06.1.454.CMB.2.raw
  modified_base (363)..(363): a, c, t, g, unknown or other
  misc_feature (363)..(363): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaatatgaatatgtctctggtaccaacagtacccaggcaaagcccccaaaactgatgatttatgatgtcagtaaatcgacctcgaggggtttctgatcgctttcttgcctcaagtctggcaacncgcctcctgaccatctctgggctccagactgaggagaggctagattattactgcagctacacactaacaagccgcgaggtcgggtttggggtcggttcggggacgggggtacccaacgtacgtcgaaacccggtctacggtaccgacggcccgaaaggtccgtccggcccctcggtacctaccgtccgtcgtttcccccg

SEQ ID NO: 344224 - DNA, 541 bp, Homo sapiens
  misc_feature: GZ8MTXP02HBANK.10.28.C06.1.454.CMB.2.raw
  modified_base (303)..(303): a, c, t, g, unknown or other
  misc_feature (303)..(303): n is a, c, g, or t
  modified_base (357)..(357): a, c, t, g, unknown or other
  misc_feature (357)..(357): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcttggtaccaacagtacccaggcaaagcccccaaactgatgatttangatgcagtatcgacctctagggtttctgatcgctttcttcgctcagtctgcacncgcctcctgaccatctctgggctcagactgaggacgagctgacttattactgcagctcacatacagcgcgaggtcgggttgggtggttcggggcgggggacctacgacgtcggtaccgtaccgtacggtccacgacccgaaggtccgtccggccccctcggtccaccttccgtcgtttaccccc

SEQ ID NO: 344225 - DNA, 521 bp, Homo sapiens
  misc_feature: GZ8MTXP02J1EWS.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctggtggaggtcggggggaggcttgggtacagccgtggggggtccctgagactctcctgtgtagcgtctggattcacattcagtagttatagcatgaactggtccgcaggctccgaggggaggggctggagtgggttcatatatgatagaaatagtggaccatatactatgcagactctgtgagggggtccgattcaccatctccagacgacaagtgaccaggaattcactgtatgtagaaatgaaacagtctagacgacgacgaaggacacggctctctatcgtgcgcgagacgacccgaaagtacgg

SEQ ID NO: 344226 - DNA, 552 bp, Homo sapiens
  misc_feature: GZ8MTXP02HN8NI.10.28.C06.1.454.CMB.2.raw
  modified_base (309)..(309): a, c, t, g, unknown or other
  misc_feature (309)..(309): n is a, c, g, or t
  modified_base (481)..(481): a, c, t, g, unknown or other
  misc_feature (481)..(481): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaaggtgtccggtgtgaggtgcagctggtggaggtcggggggaggcttgggtacaggccgtggggggtccctgagactctcctgtgtagcgtctggattcacattcagtagttatagcatgaactgggtccncaggctcgagggagggctggagtgggttcatatatgatagaaatagtagaaccatatactatgcagactctgtgacggggccattcaccatctaccagaagacaaatgaccaaggtaattcacttagtatagtaggaaaatggaaacagttcagagacggaccgagaaaccncggcttacctacttaacttactgtaacggacgaaggaccgaaccccgtaaaaagtcggggttaactaaacg

SEQ ID NO: 344227 - DNA, 537 bp, Homo sapiens
  misc_feature: GZ8MTXP02ITU5K.10.28.C06.1.454.CMB.2.raw
  modified_base (317)..(317): a, c, t, g, unknown or other
  misc_feature (317)..(317): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctggtggaggtcggggggaggcttggtacagcctgggggatccctgagactctcctgtgtagcgtctggattcacattcagtagttatagcatgaactgggtccncaggctccgaggggagggctggagtgggttcatatattgatagaaattagtggaaccatatactatgcagactctggtggagggggcctagttcacctatctccaagagaacaaatcgaccaggaacttcactgtatggtaggaaaatgaaactgtcgtagagagccggaggacgacggctacgtctaattactgtcgacgtacgacgacccgtaaaagg

SEQ ID NO: 344228 - DNA, 640 bp, Homo sapiens
  misc_feature: GZ8MTXP02JX493.10.28.C06.1.454.CMB.2.raw
  modified_base (347)..(347): a, c, t, g, unknown or other
  misc_feature (347)..(347): n is a, c, g, or t
tcagcatagtagtgcacgaccggtgctcgatttagagctcacgtattggggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccacagttacattggtaaataatgaattatgtctcctggtaccaacgacgtacccaggaccaaacgcccccaaatgatgtatttatgatgtacaagtaactccgaccctagtagggtttcngattcgactttcttcgcctacgacgtcgtggaccaacgccggtcccttacccgtacgaccctatcccgttcgtcggggtaccttacccgaagtacgtaggaacgggaccgaggtctagtaacttagtactgacagtctacagactaacgacgtcgacgtagggtcgggttgggtcggttaccgggggacggggtaccacggtacgtccggtaccgtaccgtacggtaccgaccggaacccgtaggtcccgtccggaccccgttcggtccgtacctttccgtccgttacccccg

SEQ ID NO: 344229 - DNA, 618 bp, Homo sapiens
  misc_feature: GZ8MTXP02GTCNT.10.28.C06.1.454.CMB.2.raw
  modified_base (317)..(317): a, c, t, g, unknown or other
  misc_feature (317)..(317): n is a, c, g, or t
  modified_base (394)..(394): a, c, t, g, unknown or other
  misc_feature (394)..(394): n is a, c, g, or t
  modified_base (410)..(410): a, c, t, g, unknown or other
  misc_feature (410)..(410): n is a, c, g, or t
tcagcatagtagtgcacgaccggtgctcgatttagagctcacgtattggggtttggggagctctcagagaggtgccttagccctggattccaaggcatttccacctggtgatcagcactgaacacagaggactcaccatggagttggggctgtgcttgggttttccttgttgcttattttagaaggtgtacggtgtgaggtgcagctgggtgggaggtcggggggaggcttgggtacaggccgtggggggtccctggagactctcctgtgtagcgtctggattcacattcagtagttatagcatgaactgggtcccnccaggcctccgaggggagggctggagtgggttcatatatgatagaaatagagaaccatatactatgcagactctggngaggggccattcaccntcctccagacgacaaagtcgacccgtaaggtaaacttccgaagttgtaagttaggtaaggaaaattggaaactaggtccgtaggaacggacggacccggaagggaacctaccggggtccttacgttaccgttaacgtttaccgtggtaaccggacgaacggacccggaaacccccggtaaaaagttaccgggggtacctttaaaacgg

SEQ ID NO: 344230 - DNA, 534 bp, Homo sapiens
  misc_feature: GZ8MTXP02FH3B2.10.28.C06.1.454.CMB.2.raw
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
tcagcatagtagtgcacgaccggtgctcgatttagagctcacgtattgggtttgggggggtctcaggaggcgaccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggaaataatgaaatatgtctcctggtaccaacagtacccaggcaaacgcccccaaatgatgatttangatgtcagtaatcgaccctcgaggggtttctgtatcgtctttcttcgcctccaagtctggacaacncggcctcctgaccatctctgggctcagactgaggacgaggctgattatactgcagctcacataacgaagcganaggcggttgggtgttcggggcgggggtaccacgactgaccgtccgtaggtcacgccaaggctcgccccgtcgccacgtcctcgttcccccg

SEQ ID NO: 344231 - DNA, 574 bp, Homo sapiens
  misc_feature: GZ8MTXP02J3AV0.10.28.C06.1.454.CMB.2.raw
  modified_base (212)..(212): a, c, t, g, unknown or other
  misc_feature (212)..(212): n is a, c, g, or t
  modified_base (380)..(380): a, c, t, g, unknown or other
  misc_feature (380)..(380): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctggggcccagtctgccctgactcagcctgcctccgtgtctgggtctcctggacagtccataaccntctcctgcactcggaccccacagtttacattggtaataatgaatatgtccttcctggtaccaacacgtaaccccaggccaaaacgccccccaaaactgatgatttatgatgtcagtaatcgaccctcaggggtttctgatcgtcttctttgcccctcagtctggcacncgcctcctgaccatctctgggctccagactgaggacggagtctagtattattactgcagctacacatacgaagcgcgaggtcgggttgggtcggggttcgggccggggggaccacgtactcgaccgtccgtacggtcacgcccaacggccttaaccgcccccgttcggcctactccttcttaccccctaccccc

SEQ ID NO: 344232 - DNA, 547 bp, Homo sapiens
  misc_feature: GZ8MTXP02HERN3.10.28.C06.1.454.CMB.2.raw
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (423)..(424): a, c, t, g, unknown or other
  misc_feature (423)..(424): n is a, c, g, or t
  modified_base (430)..(430): a, c, t, g, unknown or other
  misc_feature (430)..(430): n is a, c, g, or t
  modified_base (528)..(528): a, c, t, g, unknown or other
  misc_feature (528)..(528): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattgtaataatgaatatgtctctggtaccaanagtaccaggcaaacgccccaaactgatgatttangatgtacagtaatcgaccctgaggggtttcngatcgcttcttcgcctctaagtctggacctaacgccggcctcctgacctatctcgtcgggcctccagactgaggacgagctgaattatatgnngctcanatacagcgcagtcggtgggtggttcgggacgggggacacgacgtcggtaccgtccgtacggtaccacgtcccgaaggccgtcgcccccgtcggtaccnccgttcctccggttccccc

SEQ ID NO: 344233 - DNA, 562 bp, Homo sapiens
  misc_feature: GZ8MTXP02FX5DB.10.28.C06.1.454.CMB.2.raw
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatgttgggcattataaccttgtctcctggtatcaacaacgccagacaaacgcccccacactcttgatttatgaatcagtaagcgccctcgagggtttctagtcgcttctctcgcctccaagtctggcaacncggcctcctgacatctctggctcagctgacgacgagctgaatatacngacagctacacatacaagcgcgagcggttgggtcgttcgggcgggggtaccacgacgtacggaccgtccgttacggtccgaacggccccgaaacgggcccgtccggccccccgttacgggtccctaccgttcccgtccgtttacccccccg

SEQ ID NO: 344234 - DNA, 598 bp, Homo sapiens
  misc_feature: GZ8MTXP02I5KLB.10.28.C06.1.454.CMB.2.raw
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (369)..(369): a, c, t, g, unknown or other
  misc_feature (369)..(369): n is a, c, g, or t
  modified_base (447)..(447): a, c, t, g, unknown or other
  misc_feature (447)..(447): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggaataatgaatatgtctccgtggtaaccaacngtacccaggacaaacgcccccaaactgatgatttangatgtacagtancgaccctcgtagggtttctgatcgctttcttgcctcaagtcgtgaccacnccggtcctccctgacctattctcgtcgggtcctcgtaagacgtaggacggacgtaggcctaggttaatttacttacgngtacacgtctacacgatacgaagcgacgaggtcgggttagggtggttacggggcggggactacgacgtacggtacccgtacgtacggtcaaccggcccgtaaacggccgtcccgtccccgttaccggcctaccgtccgtccgtttcccccg

SEQ ID NO: 344235 - DNA, 558 bp, Homo sapiens
  misc_feature: GZ8MTXP02FSWL0.10.28.C06.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (368)..(368): a, c, t, g, unknown or other
  misc_feature (368)..(368): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccngcagtgacgttggtgttataactntgtctctggtaccaacacaccaggacaaacgccccaaactcatgtattttgatgtcagtaatcgcctcgaggggtttctaatcgcttctctggcctcaagtctggcaacacgcctccngaccatctcgtcgggctccaggctgaggacgaggctgtattattactgcagctacaatatacaacagacagctacttctagtacgttcgggacggtacggaaccgaaagccgtacggacccgtccgtaacggtccaacggaacccgaaacgggtcctacccggtacccccgtcggtcctaccgtttcccg

SEQ ID NO: 344236 - DNA, 522 bp, Homo sapiens
  misc_feature: GZ8MTXP02FM8DI.10.28.C06.1.454.CMB.2.raw
  modified_base (488)..(488): a, c, t, g, unknown or other
  misc_feature (488)..(488): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtgggaggtcggggggaggcttgggtacaggcctggggggtccctgagactctcctgtgtagcgtctggattcacattcagtagttatagcatgaactgggtccgccaggctccgaggggaaggggctggagtgggtttcatatattgatagaaatagtggaaccatatactatgcagactctagtgaggggccattcacatctccaagagacaatgccaaggattcatgtatgtagaaatgaacagtctagagagccggaggacacggctcgtactattacngtgcgacgacgacccgaaaagacgggtactaacg

SEQ ID NO: 344237 - DNA, 524 bp, Homo sapiens
  misc_feature: GZ8MTXP02IWUZM.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctgggtggaggtcggggggaggcttggtacagccgtgggggtccctgagactctcctgtgtagcgtctggattcacattcagtagttatagcatgaactgggtccgccaggctccgagggaggggctggagtgggttcatatattgatagaaatagtgaccatatactatgcagactctgtgaggggccgattcaccatctaccagacgacaaatgaccaaggtatacatgtatgtagaaatgaactagtctagagagcgaggacgacggctctactataacgtgtacgcgagacgacccgaaaagtacgg

SEQ ID NO: 344238 - DNA, 559 bp, Homo sapiens
  misc_feature: GZ8MTXP02HO0OY.10.28.C06.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattgtaaatatgaatntgtctcngtaccaanagtaccagcaaacgccccaaatgatgatttangatgacagtatcgacctgtagggttngatcgtcttcttcgcctcagtctggacacncgcctctcgacctntcgctcggctcagacgtaggaggacgnggctagtaattacttacncgacactctacacacgaacgacgcgacgtagggtcgggttcgggtcgggtcggggacgggaccacgtacgtcgtaccgtacgtacgaccgacgaccgacgtccgtcccgtaccccgtcgtacctaccgttccttacccgtacccc

SEQ ID NO: 344239 - DNA, 619 bp, Homo sapiens
  misc_feature: GZ8MTXP02FPYDX.10.28.C06.1.454.CMB.2.raw
  modified_base (308)..(308): a, c, t, g, unknown or other
  misc_feature (308)..(308): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggaggtcggggggagcttggtacaggccgtgggggtccctgagactctccgtgtgtagcgtctggattcacattcagtagttatagcatgaactgggtccnccaggctaccgaggggaaggggctgggagttgggtttcagttatattgatagaaatagtaggaaccatatactatgacagtactcgtggtggagggggccctagttaccaccctaagtcctaccgaagaacgaacaaacgttcgacccgaaaggtaactttacgacgttagttaagttaggtaaggtaaaagttacggaaacgtaggttacgtaggaaggacggaccggagggaaccacgggtccttactacgttacttacgttgtcggacgaacggaccgaaccccgtaaaagtacgggtacttaaacgg

SEQ ID NO: 344240 - DNA, 617 bp, Homo sapiens
  misc_feature: GZ8MTXP02JHZST.10.28.C06.1.454.CMB.2.raw
  modified_base (307)..(307): a, c, t, g, unknown or other
  misc_feature (307)..(307): n is a, c, g, or t
  modified_base (374)..(374): a, c, t, g, unknown or other
  misc_feature (374)..(374): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggttctgggcccagtctgccctgactcagcctgcctccgtgtctgggtctcctggacagtccatcaccatctcctgcactcggacccacagttacattaggtaaataatgaatatgtctctggtaccaacagtaccaggacaaacgcccccaaatgatgtatttangatgtcagtaactccgaccctgtaggggtttctgtatcgtctttcgttcgcctacatcgtgacaacncggccctcctcgacctatctcgtcgggcctacgagtacgtggacggacgagctagtattagtacgtgacgactctacacataacgacggcggcgaggggttcggggttggggtcgggttacgggggacggggtaccacggtaccgtcggtacccggtacgttaccggtacgaccggacccgtaacggtccgtccccggtaccccgtcgggtacctaccggttccgttcccgggtttccccccg

SEQ ID NO: 344241 - DNA, 668 bp, Homo sapiens
  misc_feature: GZ8MTXP02FTOZX.10.28.C06.1.454.CMB.2.raw
  modified_base (596)..(596): a, c, t, g, unknown or other
  misc_feature (596)..(596): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctctagtaccaacacgtaccaggacaaacgccccaaatgatgtattatgatgtcagtaatccgacctcgtaggggtttctgtactcgtctttcttcgcctacaacgtcgtggacaaacgaccggcctcccgtacgacccctatcctcgtcggggtcctaccgaagtacgtggaacgggaacggtacgggcttagttaaatttaacgttaccgtgaccgacgtacctacaaactaaacgtaaaccgaaacgggccgggacgtaacggggtcggggtttacgggggttcgggttccgggggacccgggggtaaccacgtacgtacgtacccgtcgtacggtcgacgacccgacgccgtacccgtccccgtcggtaccnccgttcccgttccgtcccccgtccctcccttacccaaccgttactacgtcgtccgtcggacggtcgggaccg

SEQ ID NO: 344242 - DNA, 516 bp, Homo sapiens
  misc_feature: GZ8MTXP02GBCRK.10.28.C06.1.454.CMB.2.raw
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtgggaggtcggggggaggcttgggtacaggccgtggggggtccctgagactctcctgtgtagcgtctggattcacattcagtagttatagcatgaactgggtccnccaggctccgagggaggggctggagtgggttcatatatgatagaaatagtggaaccatatactatgcagactcngtgagggccgattcacatctccagagacatgaccaggattcactgtatgtagaaatgaacagtctagagagcgaggacacggactctctatactgtcgacgacgacgacccgaaaagtacgggtactaacg

SEQ ID NO: 344243 - DNA, 519 bp, Homo sapiens
  misc_feature: GZ8MTXP02FQQJC.10.28.C06.1.454.CMB.2.raw
  modified_base (307)..(307): a, c, t, g, unknown or other
  misc_feature (307)..(307): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggagtcggggggaggcttggtacagcctggggggtccctgagactctcctgtgtagcgtctggattcacattcagtagttatagcatgaactggggtccnccaggctccgaggggaaggggctggagtgggtttcatatatgatagaaatagtggaaccatatactatgcagactctgtgaggggccgatcaccatctccagagacaaatgaccaggaattcactgtatgtaggaaatgaacagtctagagagaccgagaacacggactctactattactgtgcgagacgacccgaaaagtcggtactaacg

SEQ ID NO: 344244 - DNA, 571 bp, Homo sapiens
  misc_feature: GZ8MTXP02IVHA1.10.28.C06.1.454.CMB.2.raw
  modified_base (269)..(269): a, c, t, g, unknown or other
  misc_feature (269)..(269): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttangatgtcagtaatcgaccctcgaggggtttctgattcgtctttctttcgcctccaagtctggccaaccncggcctccctgaccccntcctcgtcggctaccagactgacggacgagctagatttattactgcagctacaactatacaagcggcaggtcgggtttggggtacggttcgggggcgggggtacacgacgtcgacccgtcctagggtccacggcccgaaggctccggtcccccgtcggtccaccgttctccgttcccctacccctcctcctaactctactcgcgtcgacggtcggcg

SEQ ID NO: 344245 - DNA, 614 bp, Homo sapiens
  misc_feature: GZ8MTXP02FTBNA.10.28.C06.1.454.CMB.2.raw
  modified_base (233)..(233): a, c, t, g, unknown or other
  misc_feature (233)..(233): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctctggtaccaanagtacccaggacaaacgcccccaaatgatgatttatgatgtcagtaactccgaccctcgtaggggtttctgatcgtcttctttcgcctccaagtctggacaaccacgccctcctgacccctatctcgtcgggcctaccgagctggacggacgagctgatttacttactgcagctacacaataccaagcgcgacgtcggggtttgggtcgggttcggggaccgggggaccacgtacgtcggtacccgtccgtaggtccgaacgcccgaaaggtccgtacccggtcccccgtcggtacctacccgttccgttcccgttacccccgtaaccccttccctacccctaaccgttacctacgtacgtccgtaggaccggtcgggccg

SEQ ID NO: 344246 - DNA, 613 bp, Homo sapiens
  misc_feature: GZ8MTXP02F6NSF.10.28.C06.1.454.CMB.2.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctctggtaccaacagtacccaggacaaacgcccccaaatgatgatttatgatgtacagtaactccgaccgttcgtaggggttctgtactcgtctttcttccgcccttacgaagtcgtacggaccaaaccgtccggtccctaccctagaccctactccgtccgtcggtccctaccacggtaccgtagggacgggaacgaggtcttaggtaatttactacgtgactacgctacacaacgtaacaaggtccgacgtaggtcgggttgggtcgggtcggggaccggggacacgtacgtacgccgtacgtacgccgtacgccgacggtccgtccgccccgtcgtccaccgtctccgtaccccc

SEQ ID NO: 344247 - DNA, 555 bp, Homo sapiens
  misc_feature: GZ8MTXP02FYR8U.10.28.C06.1.454.CMB.2.raw
  modified_base (269)..(269): a, c, t, g, unknown or other
  misc_feature (269)..(269): n is a, c, g, or t
  modified_base (367)..(367): a, c, t, g, unknown or other
  misc_feature (367)..(367): n is a, c, g, or t
  modified_base (450)..(450): a, c, t, g, unknown or other
  misc_feature (450)..(450): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcttggtaccaanagtacccaggcaaacgcccccaaatgatgatttatgatgtcagtaatcgaccctgagggtttctgatcgtcttcttcgcctccaagtctggaccaacnccggccctcctgacccatctctgggctccagactgaggacgaggctagtatttattactgtacagctacacataaccagcggnaggcgggttgggtcggtcggggacgggggacacgacgtcgacccgtcgtacggtcacgccgaacggccgtacgcccccgtcggtccacttccgtcgtttaccccc

SEQ ID NO: 344248 - DNA, 598 bp, Homo sapiens
  misc_feature: GZ8MTXP02IOZGC.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaggtgtccggtgtgaggtgcagcgtgggtgggaggtcggggggaggcttgggtacaggccgtggggggtccctgagactctcctgtgtagcgtctggatcactattcagtagttatagcatgaactgggtccgcaggctccgaggggagggctggagtgggttcatatatagataagaaatagtagaaccatagtactatgacagactcgtggtggagggggccattcacccatctaccagacgaacaatgacccgtaaggtaaactttcacgttagtagtagtaagggtaaatagaacctaagtcgtaggaagacggaccggaggaccgaccggtcttctaccgtttaagttaccgttggaacgacggaaacggaaccggtaacccccggtaaaaaagttcggggtaacctttaaacg

SEQ ID NO: 344249 - DNA, 693 bp, Homo sapiens
  misc_feature: GZ8MTXP02H3CI7.10.28.C06.1.454.CMB.2.raw
  modified_base (322)..(322): a, c, t, g, unknown or other
  misc_feature (322)..(322): n is a, c, g, or t
  modified_base (389)..(389): a, c, t, g, unknown or other
  misc_feature (389)..(389): n is a, c, g, or t
  modified_base (403)..(403): a, c, t, g, unknown or other
  misc_feature (403)..(403): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctggtggaggtcggggggaggcttggtacaggccgtgggggtccctggagactctcctgtgtagcgtctggattcacattcagttagttatagcatgaactggggtcccncgaggctccgaggggaaggggcgtggagtgggttcatatattgataagaatagtagacatatactancgcagtactcgtgnggtacgggggctacttccgaacctaacttccaccgaagacgaaacctaagtcgacccgtaaagggtaaacttacccgtacgttagttaagttagggtaaacgggtaaaagtaacggttaaaccgaaggttaccgttaaggggaaacgggtaacgggaccccgggtaaagggaacccgaaaccggggttacctccttttaacggttaaccttttaaccgttaggggttacggtaccggtaacggtaaaccccgggaaaacccccggttaaaaaacggtttaaacccggggg

SEQ ID NO: 344250 - DNA, 659 bp, Homo sapiens
  misc_feature: GZ8MTXP02FWD37.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttcctgttgctattttagaaggtgtccggtgtgaggtgcagctggtgggaggtcggggggaggcgttggtacaggccgtgggggtccctggagactctcctgtgtagcgtctggattcactattcagtagttatagcatgaactgggtccgcaggcctcgagggaggacggtgagggtggttcgtatagtatagtagtaagtaaagtaagtagaaccgtaactagtactaatagcgacgtaacgtcttcgtggtacggggacccggtatacctaccctaactacctccctaacgaagacgaaaatacgtaccgaaacgtaaagttactaaccgttagttaaggttagtaacggtaaaagtaggtaacgtaaagtcgttaggaagaacgtacccgggacggaaacgacccgggtacttacctcgtttaaacgtacgtttacggtgtacggaacggaaacggtaccccgtaaaaacggttaacgggttacccgttaaacgg

SEQ ID NO: 344251 - DNA, 565 bp, Homo sapiens
  misc_feature: GZ8MTXP02GR8LC.10.28.C06.1.454.CMB.2.raw
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggacaaacgcccccaaaactgatgatttangatgtcagtaatccgaccctcgtaggggtttctgtatcgtcttcttcgcctcagtctgacacncgcctcctgacctatctcgtacggctcgagacgtgaggacgaggctgtattactactgacagctcaacataacgagcgcgaggcgggttgggtgttcggggcgggggtaccacgacgtacgtaccgtcgtacggtcgaacgaccgaacggccgtccggcccccgtacggtcccgtactccgttccgtttcccccg

SEQ ID NO: 344252 - DNA, 557 bp, Homo sapiens
  misc_feature: GZ8MTXP02FEUFI.10.28.C06.1.454.CMB.2.raw
  modified_base (307)..(307): a, c, t, g, unknown or other
  misc_feature (307)..(307): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagtacccaggacaaacgcccccaaatgatgatttangatgtcagtaatccgaaccctgtaggggtttctgtactcgtctttcttcgccctcaagtctggaccacgccgcctccctgaccatctcgtgggcctcagactgaggacgaggctagtattatactgcagctacanatacagcgngagtcgggttggtcggtcggggcgggggaccacgacgtcgtaccgtccgtagtccgacgcccgaaggccgtccgcccccgtcggtcctacctcctccgttaccccc

SEQ ID NO: 344253 - DNA, 568 bp, Homo sapiens
  misc_feature: GZ8MTXP02GWTFW.10.28.C06.1.454.CMB.2.raw
  modified_base (307)..(307): a, c, t, g, unknown or other
  misc_feature (307)..(307): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctctgcactggacccacagttacattggtaaataatgaatatgtctcctggtaaccaacagtacccaggacaaacgcccccaaatgatgatttangatgtacagtaatccgaaccctgtaggggtttctgatcgtctttcttcgcctcaagtctggacaacgcgcctcctgaccntcnctggctcagactgagacgagctagaattatactgacagctactatatagtagagttggtcgtcctttcgttacgtaagggttttcgggacgggacgggtaccgagggtctacggtaacccgtactaacggtcacgaacccgaacggccgtacccgccccgtcggtcctacctttcccg

SEQ ID NO: 344254 - DNA, 569 bp, Homo sapiens
  misc_feature: GZ8MTXP02HV5UY.10.28.C06.1.454.CMB.2.raw
  modified_base (283)..(283): a, c, t, g, unknown or other
  misc_feature (283)..(283): n is a, c, g, or t
  modified_base (467)..(467): a, c, t, g, unknown or other
  misc_feature (467)..(467): n is a, c, g, or t
  modified_base (518)..(518): a, c, t, g, unknown or other
  misc_feature (518)..(518): n is a, c, g, or t
  modified_base (554)..(554): a, c, t, g, unknown or other
  misc_feature (554)..(554): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggacaaacgcccccaaatgatgtatttatgatgtcagtaanccgaccctgaggggtttctgatcgtcttctttcgcctacaagtctggacaacgacggtccctcctcgacccctatcctcgtcggctccgagccgtggacggacgaggctagtatttattactgcagtcctacaacactacgaagcggcgaggtcgggttgggtcgggttcgggcgggggtaccncgtacgtcgaccgtcgtagtcgacgaccgagccgtccgcccgtcggtaccnctccgtcctccccaccctcctaccaactacctctcncgtacgcggcggtcg

SEQ ID NO: 344255 - DNA, 632 bp, Homo sapiens
  misc_feature: GZ8MTXP02G8TS6.10.28.C06.1.454.CMB.2.raw
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
tcagcatagtagtgcacgaccggtgctcgatttagagctcacgtattgggtttgggggagctctcagagaggtgccttagccctggattccaaggcatttccacctggtgatcagcactgaacacagaggactcaccatggagttggggctgtgctgggttttccttgttgctatttagaaggtgtccggtgtgaggtgcagctgggtgggagggtcggggggaggtcgttggtacgaggccggtggggggtccctgagactctcctgtgtagcgtctggattcactattcagttagttatagcatgaactcgggtccgcgacggctcgaggggaggggctggaggtgggttnatatatgatagaatgagaacatatactatnacagtactcgtggtcgggaggggtcccgtattacccgaccctatacctacccgaaggaacgaaccgtaaatcggaaccgaacgggtaaacttcgtaacgttaggttagttaggtaaggtaaaataggtaaaccgtagtacgtaggaagacggaccggaaagaccgacggtaccttacttacgttaacttcgtacggtggaccgaacggaacccggaaccccggtaaaagttaccggggtacttaaacgg

SEQ ID NO: 344256 - DNA, 605 bp, Homo sapiens
  misc_feature: GZ8MTXP02II7X6.10.28.C06.1.454.CMB.2.raw
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctggttttccttgttgctatttagaaggtgtccggtgtgaggtgcagctggtggaggtcgggggagcgttggtacagccgtgggggtccctgagactctcctgtgtagcgtntggattcactattcagtattanagnatgactgggtccgcaggctcgaggggagggctggagtggttcatatatgatagaatagagaacatatactatgacagactcgtggaggtacgggggaccctattccaccgtattccacgaaagtacgaacaaagtcgaaccgtaaggtaactttccaagttgtagtagtaggaaaacttgaaaactgtactggaacgaacggacccgtaaaggggaccctaaacggggtcccttacgttaccttaacgttttaacgcgttaacggacggtaacgaaccgtaaccccggtaaaaagtacggggtttacctaaacgg

SEQ ID NO: 344257 - DNA, 543 bp, Homo sapiens
  misc_feature: GZ8MTXP02IYSED.10.28.C06.1.454.CMB.2.raw
  modified_base (319)..(319): a, c, t, g, unknown or other
  misc_feature (319)..(319): n is a, c, g, or t
  modified_base (385)..(385): a, c, t, g, unknown or other
  misc_feature (385)..(385): n is a, c, g, or t
  modified_base (507)..(507): a, c, t, g, unknown or other
  misc_feature (507)..(507): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcgttgggtacgaggccgtggggggtcccctggacgactctcctgtgtagcgtctggattcacattcagtagttatagcatgaacgtggggtccnccaggcctccgaggggaggggctggagtgggttcatatatgatagaatagtgaaccatatactatncagtactcgtgtggaggggccgtatcacctatctaccagacgaacatgaccaggtatacgactgtatggtaagaatagaacagtctagagcgaccgagaacgacggctacgtctacgttacngtaacgcgagacgacccgaaaagttcggtactaacg

SEQ ID NO: 344258 - DNA, 596 bp, Homo sapiens
  misc_feature: GZ8MTXP02I5X46.10.28.C06.1.454.CMB.2.raw
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctggtaccaacagtacccaggcaaaacgcccccaaactgatagatttangatgtcaagtaatcgaccctcgtaggggtttctgatcgtctttctttcgcctccaagtctggacaacnccggtcctccctgacccagtcctctgggcctccgaagtacctggaacggacgaggctagtaattattactgtcagtcctacacaataaccgaagacggcgacggtcgggttagggtcggttcggggaccgggggaaccaccgtacgtcgacccgtccgtaacggtccgaacgacccgtaaggcccgtcgcccccgtcggtccaccgtcctacgttccccccg

SEQ ID NO: 344259 - DNA, 658 bp, Homo sapiens
  misc_feature: GZ8MTXP02IQHMG.10.28.C06.1.454.CMB.2.raw
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatcctcctgcactcggacccactagttactattaggtaataatgaatatgtctcctacggtaccaacacgtaacccaggacaaaccgacccccaaatgatagtatttatgatgactaagtactccgacccttcggtaggggtttctgtactcgtctttcttccgtccctacacgtctggaccaaccgccggtccctaccctcgacctacttccgtcgttcgggcctacccgaacggacgtacgggaacgggtaccgggaacggtcctaaggttaactttaacttacgacgtacgactcctaactacgtaactaacggaacgcgggtacgtacggtcggggttagggtcggtaccgggggacggggacctacgacggtcggtaccgtacgtacgtcgaacgcccgtaacggccctccggcccctcggtacctcctcgtccccgtacccc

SEQ ID NO: 344260 - DNA, 540 bp, Homo sapiens
  misc_feature: GZ8MTXP02F9ERT.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggaggtcggggggaggcttggtacaggccgtgggggtccctgagactctcctgtgtagcgtctggattcacattcagtagttatagcatgaactgggtccgccaggctccgaggggaaggggctggagttgggtttcatatattgatagaaatagtagaaccatatactatgacagactcgtgtggaggggccgattcgaccatcctccagagacaatcgaccgaaggtacttcacgttgttagtgtaggaaaattgaaactagtctagagacgcgaggacacggctcgtactatcgtagtgcgagaccgacccgtaaaagtcggtactaacg

SEQ ID NO: 344261 - DNA, 549 bp, Homo sapiens
  misc_feature: GZ8MTXP02JIUEE.10.28.C06.1.454.CMB.2.raw
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (468)..(468): a, c, t, g, unknown or other
  misc_feature (468)..(468): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctgggtggaggtcggggggaggcttgggtacaggccgtggggggtccctggagactctcctgtgtagcgtctggattcacattcagtagttatagcatgaactggggtccnccaggctccgaggggaggggctggagtgggttcatatattgatagaaatagnggacatatactatgcagactctgtggacggggcattcacatctccagagacaaatcgaccaaggaattcactagtatggtagaaatgaaacngtactggacgacgaccggaggacgacgcgtactactacttaacgtgtacgaccgagaccgtaaccccgaaagttaaccggg

SEQ ID NO: 344262 - DNA, 655 bp, Homo sapiens
  misc_feature: GZ8MTXP02HM0V1.10.28.C06.1.454.CMB.2.raw
  modified_base (309)..(309): a, c, t, g, unknown or other
  misc_feature (309)..(309): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtcgtgggtctcctggacagtccatcacatctctgcactcggacccacagttacagttggaaataatgaattatgtctcctggtaccaacacgtaccaggacaaacgacccccaaatgatagtatttangatgtcaagtaatccgaccttcggtaggggtttcagactcgtctttcttccgccctactaagtctggaccctaacgccgggtccctaccgtcgacccctagttccgtcggtcggccttaccagtactagggacggtacgacgtcgttagtaactttacgttacgtacgtacacgtactaccgtaactacgttaacgaacgggaccggacggtacggggtcggggttacggggttcgggttccgggggaccgggggtaaccacggtaccgtacggtcccgtacgtaacggtcgaccgtccgacggtccgtccgccccgtcggtacctccgtccgttccgttaccccc

SEQ ID NO: 344263 - DNA, 530 bp, Homo sapiens
  misc_feature: GZ8MTXP02H279M.10.28.C06.1.454.CMB.2.raw
  modified_base (311)..(311): a, c, t, g, unknown or other
  misc_feature (311)..(311): n is a, c, g, or t
  modified_base (493)..(493): a, c, t, g, unknown or other
  misc_feature (493)..(493): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggaggcttgggtacaggccgtggggggtccctgagactctcctgtgtagcgtctggattcacattcagtagttatagcatgaactgggtccncaggctccgaggggaagggctggagtgggttcagtatattgataagaaatagtagaaccatatactatgcagactctgtagacggggcattccacattcaccagagacatcgaccaggtaattcgatgtatgtaggaaaactgaacagtcagagacgcggagacacggctacctctattacngtcgcgtaagacgaacccgaaaagtcgggtactaacg

SEQ ID NO: 344264 - DNA, 556 bp, Homo sapiens
  misc_feature: GZ8MTXP02H0G1L.10.28.C06.1.454.CMB.2.raw
  modified_base (317)..(317): a, c, t, g, unknown or other
  misc_feature (317)..(317): n is a, c, g, or t
  modified_base (388)..(388): a, c, t, g, unknown or other
  misc_feature (388)..(388): n is a, c, g, or t
  modified_base (436)..(436): a, c, t, g, unknown or other
  misc_feature (436)..(436): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaggtgtccggtgtgaggtgcagctgggtggaggtcggggggaggcttggtacaggccgtggggggtccctgagactctcctgtgtagcgtctggattcacattcagtagtatagcatgactgggtccncaggctccgagggagggctggagttgggttcatatattgataagaatagtagacctataatactatgcaanctacgtgtggacgggggcctattccgacctaatcctaccagtacgaanaaactcgaccaggtaattcgactgtatggtaaggtaaatagaacagtcgagacggacggacgacgacgacggtctactacttataacgtgtacgacgagaccgtaacccgtaaagtacgg

SEQ ID NO: 344265 - DNA, 585 bp, Homo sapiens
  misc_feature: GZ8MTXP02GEPJD.10.28.C06.1.454.CMB.2.raw
  modified_base (313)..(313): a, c, t, g, unknown or other
  misc_feature (313)..(313): n is a, c, g, or t
  modified_base (493)..(493): a, c, t, g, unknown or other
  misc_feature (493)..(493): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggaggcgttggtacaggccgtggggggtccctgagactctcctgtgtagcgtctggattcactattcagttagttatagcatgaactgggtccncaggctccgaggggaagggctaggagttgggttcatatattgatagaaatagtaggaaccatatactatgactagactcgtgtgaagggggcccgattccgaacctagtcctacccgaagaacgacaaatcggaccaagggtaacttaccatggtaatggtaaagaaattgaactaagtntaggaagtgacgtaggagaccgacggacttctacttattacgtggtacggacgaacggtaaccgaaacccccggtaaaagtcggtttaaccg

SEQ ID NO: 344266 - DNA, 628 bp, Homo sapiens
  misc_feature: GZ8MTXP02J3FLK.10.28.C06.1.454.CMB.2.raw
  modified_base (379)..(379): a, c, t, g, unknown or other
  misc_feature (379)..(379): n is a, c, g, or t
  modified_base (385)..(386): a, c, t, g, unknown or other
  misc_feature (385)..(386): n is a, c, g, or t
  modified_base (396)..(396): a, c, t, g, unknown or other
  misc_feature (396)..(396): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttcctgttgctattttagaaggtgtccggtgtgaggtgcagctgggtgggaggtcgggggaggcgttggtacaggccgtggggggtccctggagactctcctgtgtagcgtctggattcactattcagtagttatagcatgaactcggggtccgccgaggctaccgaggggaaggggctgggagtgggttacatatattgatagaaatagtgaacatanactatnnagactctggngacgggggccattaccaccatcctaccagagacaatcgaccgaggtactacagtagtagttagtaaggaaattacggaactacggtacgtaggaagacggaccgggaacggaccgaaccgggtacttaccgttactaaacgtttaacccgtttgggtaacggtaccggaaacgggtaacccggtaaaacccccggtaaaaacggttaccgggggttaaccgtttaaacccgg

SEQ ID NO: 344267 - DNA, 557 bp, Homo sapiens
  misc_feature: GZ8MTXP02FROR9.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggaggcttgggtacaggccgtggggggtccctggagtactctcctggtgtagcgtctggattcacattcagtagttatagcatgaactggggtccgccaggcctccgaaggggaaggggcgtggaggttgggtttcatatattgatagaaataggtaggaaccatatactatgacagtactctggtggacggggcccgtattccacctatccaccagaagacaaatcgaccgaagattcacttgtaatggtagaaatgaactagtcgtagagacgacggaggacacggtctctacttactactgtcgcgacgacgacccgtaaaagtcggtactaacg

SEQ ID NO: 344268 - DNA, 530 bp, Homo sapiens
  misc_feature: GZ8MTXP02FV2P2.10.28.C06.1.454.CMB.2.raw
  modified_base (320)..(320): a, c, t, g, unknown or other
  misc_feature (320)..(320): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggaggtcggggggaggcttggtacaggccgtggggggtccctgagactctcctgtgtagcgtctggattcacattcagtagttatagcatgaactgggtccnccaggctccgagggaggggctggagtggttcatatatgatagaaatagaggaccatatactatgcagactctgtggaggggcctagttcaccatctaccagagacaaatcgaccaggtaattcactagtatgtaggaaatagaacagtctagagagaccgaggacacggctcgtctataacgtgtagacgagacgacccgaaaagtacgg

SEQ ID NO: 344269 - DNA, 647 bp, Homo sapiens
  misc_feature: GZ8MTXP02HITY2.10.28.C06.1.454.CMB.2.raw
  modified_base (389)..(389): a, c, t, g, unknown or other
  misc_feature (389)..(389): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgcttattttagaaggtgtccggtgtgaggtgcagctgggtggaggtcggggggaggcgttggtacaggccgtggggggtccctgagactctcctgtgtagcgtctggtattcactattcagtagttatagcatgaacgtcggccgcaggctccgaggggaggggctggagtggttcatatatgatagaaatagtgaccatatactatganagtctgtagtaggacgggtccgattccactacgtcctaccgaagacaactaaagtcgacccgtaagggttaaacttccgtaacgttagttaagtaggttaacgggtaaaattagggaaacctagggttaccagggtaaacggaccgggacccggaaagggtaacccgaccggggtaccttcgttaacctttagttaaccgtgggttacgaccggtaaacgaacccggtaaacccccggtaaaaaggtttaacccgggg

SEQ ID NO: 344270 - DNA, 584 bp, Homo sapiens
  misc_feature: GZ8MTXP02HC7J9.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctgggtgggaggtcggggggaggcttgggtacaggccgtggggggtccctgagactctcctgtgtagcgtctggattcacattcagttagttatagcatgaacgtggggtcccgccgaggctccgaggggaaggggcgtgggagttgggtttcatatattgatagaaatggaggaccatatactatgcagactcgtgtggaggggccattcaccatcacaagacgaacaagtcgacaggtacttcacgttgtagtgtaaggaaatggaaactaggttcaggaaggacggacccgggaaaggaccgacggtccttactacgttaaacttcgtgtacggacgtaagacccggaaacccgtaaaagttaccgggg

SEQ ID NO: 344271 - DNA, 710 bp, Homo sapiens
  misc_feature: GZ8MTXP02JPV36.10.28.C06.1.454.CMB.2.raw
  modified_base (338)..(338): a, c, t, g, unknown or other
  misc_feature (338)..(338): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctatttagaggtgtcggtgtgaggtgcagcgtgggtgggagggtcggggggaggtcgttgggtacgacggtcccggttcgggggggtcccctggacgactcttccgtggtcgtagcgttcgtggtattcactattcgagttagttatagcatgaacgtggggtcccncgaggtcctaccggaggggaaggggcgtgggtaggttgggtttacaagttattagttagaattaaagtaaaacgttaggtaacggaaacctaattactactagtcgacaagtactcgtagggtgggacggggtacctattccgacctattacccaccgaaggtaaccgaaacgtactcggaacccgtaaagggttaactttaccgacgttagttaacggtggtaaaggtaaacttagaaaaccgtggttaccgaggaaaacgcggaaccggagggacctacgggttcctacgttaccgtaatttaccggaggtaacgaacgggtaaccggaaacccgtaaacccggtaaaaggtttacccggtaactaaacg

SEQ ID NO: 344272 - DNA, 527 bp, Homo sapiens
  misc_feature: GZ8MTXP02JW1U9.10.28.C06.1.454.CMB.2.raw
  modified_base (311)..(311): a, c, t, g, unknown or other
  misc_feature (311)..(311): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtgggaggtcggggggaggcttggtacaggccgtggggggtccctgagactctcctgtgtagcgtctggattcacattcagtagttatagcatgaactggggtccnccaggctccgaggggaaggggctgggagtgggtttcatatatgatagaaatagtggaaccatatactatgcagactctgtgaggggccattcaccatctccagggacaatgaccaggaattcactgtatggtagaaatgaacagtctgagagcgaggacacggctcgtctattactgtcgcgacgacgaccccggaaaatacgggtactacgtaac

SEQ ID NO: 344273 - DNA, 523 bp, Homo sapiens
  misc_feature: GZ8MTXP02G78YI.10.28.C06.1.454.CMB.2.raw
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (439)..(439): a, c, t, g, unknown or other
  misc_feature (439)..(439): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttccttgttgctatttagaaggtgtccggtgtgaggtgcagctggtggaggtcggggggaggcttgggtacagccgtgggggtccctgagactctcctgtgtagcgtctggattcacattcagtagttatagcatgaactgggtccgcaggctcagagagggctggagtggttcatatattgatagaaatgtagaacatatactatgcagacctntgtggacggggctagttcaccatcnccgagggacaatcgacagaatctacgtgtatagagtaaangaaacagtctagagagaccgagacacggctctacgttacttacgtgtaacgcgaacgaccgacccgtaaaagtcggtactaacg

SEQ ID NO: 344274 - DNA, 553 bp, Homo sapiens
  misc_feature: GZ8MTXP02HQO1Y.10.28.C06.1.454.CMB.2.raw
  modified_base (255)..(255): a, c, t, g, unknown or other
  misc_feature (255)..(255): n is a, c, g, or t
  modified_base (304)..(304): a, c, t, g, unknown or other
  misc_feature (304)..(304): n is a, c, g, or t
  modified_base (334)..(334): a, c, t, g, unknown or other
  misc_feature (334)..(334): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
  modified_base (538)..(538): a, c, t, g, unknown or other
  misc_feature (538)..(538): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgccactcggacccacagttacattggtaaatatgaatntgtctctggtacaacagtaccaggcaaacgcccccaaatgatgatttangatgcagtaatcgaccctgtaggggtttcngatcgtctttctttccgcctaccaagtctggaccaacgccggccctccctagaccctatctcgtacgggctcagtacaggaggacgaggcttagtattactatcgatcnctacacanacgaagcgacgnggtcgggtggtgtccggggcggggacncgacgcggacctcgtagcgacgccgagtccgccgtccccgcgtctccncgtttaccctccccc

SEQ ID NO: 344275 - DNA, 535 bp, Homo sapiens
  misc_feature: GZ8MTXP02JAEV8.10.28.C06.1.454.CMB.2.raw
  modified_base (322)..(322): a, c, t, g, unknown or other
  misc_feature (322)..(322): n is a, c, g, or t
  modified_base (469)..(469): a, c, t, g, unknown or other
  misc_feature (469)..(469): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctgggtggaggtcggggggaggcgttggtacagccgtggggggtccctggagactctcctgtgtagcgtctggattcacattcagtagttatagcatgaacgtgggtccnccaggctccgaggggagggctggagtggttcatatatgatagaatagtagaccatatactatgacagactcgtgtggagggggccagttcacatcctacagagacaaatgaccaggtaattcacgtgtatggtagaaatgaacagtnagacgacgaccgaggacacggctacgtctataacgtgtacgacgagacgaacccgaaagttacggg

SEQ ID NO: 344276 - DNA, 532 bp, Homo sapiens
  misc_feature: GZ8MTXP02FQDK9.10.28.C06.1.454.CMB.2.raw
  modified_base (312)..(312): a, c, t, g, unknown or other
  misc_feature (312)..(312): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcttgggtacaggccgtggggggtccctgagactctcctgtgtagcgtctggattcacattcagtagttatagcatgaactgggtccncaggctccgagggagggctggagtggttcatatatgatagaaatagtggaaccatatactatgacagactcgtgtggaggggccattcaccatcctccagagacaatgaccaggatcatgtatgtagaaatagaactagtctagaggacgaccgaggacgacggtctctacttacttactggtgacgacgaccgaacccgaaaagtacgggtactaaacg

SEQ ID NO: 344277 - DNA, 682 bp, Homo sapiens
  misc_feature: GZ8MTXP02JXPV0.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgcttgggttttccttgttgcttatttagaaggtgtccggtgtgaggtgcagctggtggaggtcggggggagcgttggtacaggccgtgggggtccccgagactctctgtgtagcgtctggattcacatttcagtagttatagcatgaactgggtcccgccgaggcctccggaaggggaacggggtcgtagggtaggttggggtttacagttagtaatttacgaaattaaaggtaaaattacgggtaaggaaaaccctagttaaactaacttatagactaacggtacttccgttgggtacggggacgggggacccttatttcccaaacctacttcccgaaccgaaggaacgacctaaagtaccgaccgaaaggtaaacttccgtaaagttgtaagttggtaacggtaaaattcggaaaatcggtacgaggaaaacggacgaccggagggaaacccacggtccttacgtacttacgttagcgttcgacgacggaacccgaaccgtaaaagtccggttaaac

SEQ ID NO: 344278 - DNA, 527 bp, Homo sapiens
  misc_feature: GZ8MTXP02G6Z6A.10.28.C06.1.454.CMB.2.raw
  modified_base (378)..(378): a, c, t, g, unknown or other
  misc_feature (378)..(378): n is a, c, g, or t
  modified_base (451)..(451): a, c, t, g, unknown or other
  misc_feature (451)..(451): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttgggctgtgctggttttcttgttgctattttagaaggtgtcggtgtgaggtgcagctgggtggaggtcggggggagcgttggtacaggccgtgggggtcctggagactctctgtgtagcgtctggattcactattcagttagttatagcatgaactggtcccgcaggctcgaaggggaggctggagtggttacatatattgataagaaatgagacatatactatncagactctgtgacggggctagttcacatctacagacgacaatcgacagtatcgatagtatgtagaatagaacngtctagagaacgccgaacgacgacggtctacttactattaacgtgtacgacgaagaccgaacccgtaaaagtacgg

SEQ ID NO: 344279 - DNA, 635 bp, Homo sapiens
  misc_feature: GZ8MTXP02GAKSJ.10.28.C06.1.454.CMB.2.raw
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggaggcttggtacagccgtgggggtccctgagactctcctgtgtagcgtctggattcacattacagtagttanagcatgaactgggtccncaggctccgaggggagggctggaggttggttcatatattgatagaaataggtagaacctatntactatgacagacttctggtggagggggtccaattcgacctatcctaccaagaacgacaaagtcgaccgtaaggtaacttcgaacgttagttaagttggtaagggtaaaattaggaaacgtaggttaccgtagggaaggacggacccggaaacggggtaaccgaacggggtacccttacgttacgttaacgtttaccggtggttcggaccggtaaacggacccggaaccccggtaaaaaggttccggggttactttaaaaccgg

SEQ ID NO: 344280 - DNA, 673 bp, Homo sapiens
  misc_feature: GZ8MTXP02JCTSP.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaggtgtccggtgtgaggtgcagcgtgggtggagggtcgggggaggtcgttgggtacaggcccggtcggggggtccctggacgtactcgtccgtggtgtagcgttctggtatcactattcgagttagttatagcatagaacgtcggggtcccgccgaggccgtaccggaaggggaacggggcgtagggtaggttgggtttacattagttagttacgtaaagtaaagtaaaagttacggtacggtaaaaccctaattacttaacctaagtacgacctaagtacgttacgtgggtacgggacgggggtaccctaacgttcccgaacctactacctaccaagtaacgaactaacgtcgaccgaaggtaacttaccgtattagttagtaagtaacggaaagtacgaatacgttcgagacggacgaccggagaccgacgtctactactacttcgtcgaaggacgaacggacgtaacccgtaaaagtccggtacttaacg

SEQ ID NO: 344281 - DNA, 719 bp, Homo sapiens
  misc_feature: GZ8MTXP02FY9CX.10.28.C06.1.454.CMB.2.raw
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctctgtaccaacagtacccaggcaaagcccccaaatgatgattatgatgtcagtaatcgaccctgtagggtttctgatcgtcttctttgcctccaagtctggactaaaccgaccggccctccctcgaccccctattcctcgtcgggtcctacccgagtcgtggaacggaccggaaggtcttaggaatttacttaccgtgacctaagccttacaacgaacttaaccgaaaggcccgggagtaacggggtccggggtttagggggtaccgggtttccgggggaccggggggtaacccaaccgtaccgttaccggtacccccgtaccggttacgggtacccgaacggaccccgtaaacggcccgtcccgtaccccccggtcggttaccctaccgttaccccgttacccgtttcccccctaacccccttcccccttaacccctaaccgttaaacccgtaaccttacggtccgttaacgggtaccgggaccggggttacccggg

SEQ ID NO: 344282 - DNA, 593 bp, Homo sapiens
  misc_feature: GZ8MTXP02I9W09.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttgggctgtgctgggttttccttgttgctatttagaaggtgtccggtgtgaggtgcagctgggtggaggtcggggggaggcgttggtacagcctggacggggtccctgagactctctgtgtagcgtctggattcacattcagtagttatagcatgaacgtgggtcccgcaggcctccgagggagggctgggtagtggttcatatagtagaagtagaaatagtggaacctattaagtactagtgacaagtacgtcgtaggtaggacgggggcctaagtttccaacctaattcctaccgaagagaaacctaagtcgaccgtaaggtacttacgacgttagtataggtaggaaatgaaacgagtacgtagacgacgccgataccgacgaccggtcttactaaccttagttacgtgtacgaccggaacggacgtaaaaccccgg

SEQ ID NO: 344283 - DNA, 789 bp, Homo sapiens
  misc_feature: GZ8MTXP02JAN25.10.28.C06.1.454.CMB.2.raw
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (407)..(407): a, c, t, g, unknown or other
  misc_feature (407)..(407): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcgtagtaccaacagtacccagacaaacgccccaaatgatgtattngatgtacataactccgacctgtagggtttcngacttcgtcttcttcgacctccgaagtcctacggacaccgtaccggccctcccgtgaccccctatccgtacgtcggctcccgagtaccgtagggaacggaccgtaggtnttacgtaactttaacgttacgtcggaccgttaaccgtcctaaccgtaaacgtaaacgtaaccggtaacgggtaccgggtacgggttaccgggggtttaccgggggtttacgggggttacccgggggttacccgggggacccgggggtaaccctaacccgggttacccgggttaccccgggtaaccccggttaccggtaccgggttacccggacccggtaaccccgggtaccggtaccccgtacccccgggttacccccggttaccggtacccgtaccccgtttaccccggttacccccgttaccccccgtacccgttaccccgttacccgtaaccgttaccgttacggtaccggtaccgtaccgggtacggtaccgggtacg

SEQ ID NO: 344284 - DNA, 644 bp, Homo sapiens
  misc_feature: GZ8MTXP02JYU9G.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcgttgggtacaggccgtggggggtccctggagactctcctgtgtagcgtctggtattcactattcagtagttatagcatgaactgggtcccgccgaggctccgaggggaacggggcgtgggtaggttgggtttacagtatattagatagaaagtagtaggaaccatatactatgacagtactcgtgggtaggacgggggccctacgttccaaccctatcctacccaaggaagaactagtgaccccgaaaggtaacttccgaattgtaataggtaaggaaatacggaaactgtacgtaggaaagacggacccgaaaaggtaaaccgacgggtacctttacgtaccgttaagtttaaccgtgggtaacgaccggtaaacgaccggtaaaccccggtaaaaggttacgggtacttaaaaccg

SEQ ID NO: 344285 - DNA, 625 bp, Homo sapiens
  misc_feature: GZ8MTXP02IJGRZ.10.28.C06.1.454.CMB.2.raw
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaggtgtccggtgtgaggtgcagctgggtgggaggtcggggggaggcgttggtacaggccgtggggggtccctgagactctcctgtgtagcgtctggattcacattcagtagttatagcatgaacgtggggtcccgccgaggcctccgaggggaaggggcgtgggaggttgggttacatatatgataagaaatagtagaacatatactangcagactnttggngaggggacctattcacctatcctaccgagaacgaacaagtcgaccgtaaggaaatttccagtagttagtagtaaggtaaaatcgaaactaggtacgtaggaacgacggacccggaagggacccgaaaccggtccttacgttacccttagttttaaccggaggtaacgtaaccggaacggaaccccggtaaaaccccggtaaaaggttaccgggttaacctaacgg

SEQ ID NO: 344286 - DNA, 631 bp, Homo sapiens
  misc_feature: GZ8MTXP02IK5OP.10.28.C06.1.454.CMB.2.raw
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggacaaacgccccaaatgatgtatttangatgtacagtaatcgacctgtagggtttcngatcgcttcttgcctacaagtctggaccaacgaccgcctccctgacccctatctcgtgggctaccagctgaggacgagctgatttatactgacngctcaacatacaagcggcgaggcgggtttaggggtcggttcgggggaccgggggtaaccacgtaccgtacgaccgttaccgtacgggtccaacggtacccgaagggtccctcccggtccccccgttacgggtaccctaacccgtttcccgttacccggtttccccccgaccccctttacccgtacccctaaaccgttacctacgttaccgccgttacggacgggtccgggtacccgg

SEQ ID NO: 344287 - DNA, 597 bp, Homo sapiens
  misc_feature: GZ8MTXP02G3P5B.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctggtggaggtcggggggaggcttggtacagccgtgggggtccctgagactctcctgtgtagcgtctggattcacattcagttagttatagcatgaacgtggtccgccaggctccgaggggaggggctgggagtggttcatatagttgatagaaatagtaggaccatatactatgacagactctgtggacggggcgtattcgaccatctaccagagacaaatcggaccgagggtaacttccagttagtagttggtaaggtaaaattacggaaacctaggtctaggaaggacggacccgggaggaccgacgggtaccttacctacgttacttaaccgtggttacggaccggtaacgaccggaacccccggtaaaagttaaccggg

SEQ ID NO: 344288 - DNA, 524 bp, Homo sapiens
  misc_feature: GZ8MTXP02FHN8Z.10.28.C06.1.454.CMB.2.raw
  modified_base (394)..(394): a, c, t, g, unknown or other
  misc_feature (394)..(394): n is a, c, g, or t
  modified_base (459)..(459): a, c, t, g, unknown or other
  misc_feature (459)..(459): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctatttagaaggtgtccggtgtgaggtgcagctgggtgggaggtcggggggggaggcttgggtacaggccgtggggggtccctgagactctcctgtgtgcgtctggattcacattcagtagttatagcatgaactgggtccgccaggctccgaggggaggggctggagtgggtttcatatatgatagaatagtgaccatatatatgcagactntgtgaggggcatcacatctcagagacaatgaccaggtaatcactgtatgtagaaatgaacagtcngagagccgaggtacgacggctcgtcttaattaactggtcgacgagacgaccccgaaaagtacggg

SEQ ID NO: 344289 - DNA, 537 bp, Homo sapiens
  misc_feature: GZ8MTXP02GDLRP.10.28.C06.1.454.CMB.2.raw
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaaatatgtctcctggtaccaaacagtacccaggcaaagcccccaaaatgatgatttatgatgtcagtaatcgaccctgaggggtttctgatcgtctttctttgcctcaagtctgcaacncgcctcctgaccccatcctctggctccagctgaggacgagctgattatactgcagctcacatacaagcgnagcggttgggtggtcgggcgggggacacgacgtcgaccgtccgtaggtcacgccgaaggcctccgcccccgtcggtaccaccgtcctccgttccccaccctccctacctaacctactactcgctcgacgcggcg

SEQ ID NO: 344290 - DNA, 532 bp, Homo sapiens
  misc_feature: GZ8MTXP02FFJ8F.10.28.C06.1.454.CMB.2.raw
  modified_base (305)..(305): a, c, t, g, unknown or other
  misc_feature (305)..(305): n is a, c, g, or t
  modified_base (393)..(393): a, c, t, g, unknown or other
  misc_feature (393)..(393): n is a, c, g, or t
  modified_base (434)..(434): a, c, t, g, unknown or other
  misc_feature (434)..(434): n is a, c, g, or t
  modified_base (508)..(508): a, c, t, g, unknown or other
  misc_feature (508)..(508): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggaataatgaatatgtctcctggtaccaacagtacccaggacaaacgcccccaaaatgatgatttangatgtcagtaatccgaccctcgaggggtttctgtatcgtctttcttcgcctccaagtctggcaacgccgcctccctgacccatctcgngggtctcagactgaggacgagctgattatactgcagctcanataacaagcgcaggtcgggttgggtggtcggggcgggggaccacgacgtcgaccgtcgtacgcacgccaaggcncgacccctcgcactcgtctacccc

SEQ ID NO: 344291 - DNA, 572 bp, Homo sapiens
  misc_feature: GZ8MTXP02ISR38.10.28.C06.1.454.CMB.2.raw
  modified_base (318)..(318): a, c, t, g, unknown or other
  misc_feature (318)..(318): n is a, c, g, or t
  modified_base (519)..(519): a, c, t, g, unknown or other
  misc_feature (519)..(519): n is a, c, g, or t
  modified_base (537)..(537): a, c, t, g, unknown or other
  misc_feature (537)..(537): n is a, c, g, or t
tcagcatagtagtgcacgaccggtgctcgatttagagctcacgtattgggtttgggggagctctcagagaggtgccttagccctggattccaaggcatttccacctggtgatcagcactgaacacagaggactcaccatggagttggggctgtgcttgggttttccttgttgcttattttagaggtgtccggtgtgaggtgcagcgtgggtgggagggtcggggggaggcgttggtacaggccgtgggggtccctgacgactctctgtgtagcgtctggattcaactattcagtagttatagcatgaacgtgggtccncgaggcgtacggaaggggaaggggcgtggaggttggtttacatatattagaataagaaatagtagaactatatactatgcagactcgtgtggacgggccgtattaccactatctaccgaagacgaaacatcgaccgtaaaggtaacttacgtagtgtagtaggtaaggaaattagaactagtctagagacgacgagaacgngtactactactacttagngtcgagacgacgaaccgtaaagtacggtactaacg

SEQ ID NO: 344292 - DNA, 583 bp, Homo sapiens
  misc_feature: GZ8MTXP02FKULX.10.28.C06.1.454.CMB.2.raw
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaatgatgattangatgtcagtatcgaccctnagggtttcngatcgtcttcttgcctcaagtctgcaacacgcctcccgtgacccctagtctctcgggctccgagctgaggacgagctagactttatactgcagctcanatacaagcgcgagtcgggttagggtggtcgggacgggggaccacgtacgtcgacccgtcgtacggtccgacgcccgaaggtcccgtaccggtccccccgtgggttaccaccgttccgttaccggttaccccctaccccttcctaccgtaacttacgtacgtccgtaggtcggtaccgggccgttacggg

SEQ ID NO: 344293 - DNA, 642 bp, Homo sapiens
  misc_feature: GZ8MTXP02FI4VP.10.28.C06.1.454.CMB.2.raw
tcagcatagtagtgcacgaccggtgctcgatttagagctcacgtattgggtttgggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagcgtgggtggaggtcggggggaggcgttggtacaggccgtggggggtccctgagactctcctgtgtagcgtctggattcactattcagtagttatagcatagaacgtgggtcccgcgaggcctaccggaggggaacggggctgggaggtttgggttacatatatgataagaaatagtaggaaccagtatactatgacagactcgtgtggaggggaccgtattccaccgatcctaccgaagaacgaacaaagtcgacccgaaggtaaactttcgaacgttagttaagtaggtaaaggtaaaagtaggaaacgtacgtacgtagggaacggacggacccggaacgggaaccgaccgggtccttaccgttacgttaacttaccgttggtaaggaccgaacggaaccgaaccccggtaaaaaggttacgggtacgtttaaaccg

SEQ ID NO: 344294 - DNA, 625 bp, Homo sapiens
  misc_feature: GZ8MTXP02HER0C.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaaggtgtccggtgtgaggtgcagctgggtgggaggtcggggggaggcgttgggtacaggccgtggggggtccctggagactctcctgtgtagcgtctggattcacattcagttagttatagctatggaacgtggggtcccgaccgagggcctccggagggggaacggggtctaggggtagttggggtttcaattagttattgaataagaaagtaggtacgacctataatactatgacagtacctgtggtggacggggcctattccgactctcctaccgaagagaacaagtcgaccgaaggtaacttcagttagtagtagtaggaaattcgaaacgtgtacgaggaacggacggaccggacggaaacgcggtacctcgtacttacgtaacgtggtacggacggtaacgaccggtaaaccccggaaaggtttaccgg

SEQ ID NO: 344295 - DNA, 555 bp, Homo sapiens
  misc_feature: GZ8MTXP02I37JG.10.28.C06.1.454.CMB.2.raw
  modified_base (321)..(321): a, c, t, g, unknown or other
  misc_feature (321)..(321): n is a, c, g, or t
  modified_base (421)..(421): a, c, t, g, unknown or other
  misc_feature (421)..(421): n is a, c, g, or t
  modified_base (507)..(507): a, c, t, g, unknown or other
  misc_feature (507)..(507): n is a, c, g, or t
  modified_base (525)..(525): a, c, t, g, unknown or other
  misc_feature (525)..(525): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgctattttagaaggtgtccggtgtgaggtgcagctgggtggaggtcggggggaggcttggtacaggccgtggggggtccctgacgactctcctgtgtagcgtctggattcactattcagtattatagcatgaactgggtccncaggctccgaggggagggctggagttggttcatatattgataagaatagaggacctataatactatgacagactcgtgtggagggggccaattccaactntctaccaggaacacaaatcgactaaggtattaccagttagtagtaggtaagaagtagaacctagtcgagaggacgacggaggaacncggtctactgtattccgngacgtacgaagacgaacccgtaaagtacgg

SEQ ID NO: 344296 - DNA, 647 bp, Homo sapiens
  misc_feature: GZ8MTXP02GNIY5.10.28.C06.1.454.CMB.2.raw
  modified_base (284)..(284): a, c, t, g, unknown or other
  misc_feature (284)..(284): n is a, c, g, or t
  modified_base (318)..(318): a, c, t, g, unknown or other
  misc_feature (318)..(318): n is a, c, g, or t
  modified_base (381)..(381): a, c, t, g, unknown or other
  misc_feature (381)..(381): n is a, c, g, or t
  modified_base (471)..(471): a, c, t, g, unknown or other
  misc_feature (471)..(471): n is a, c, g, or t
  modified_base (606)..(606): a, c, t, g, unknown or other
  misc_feature (606)..(606): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccacagttacattaggtaaataatgaattagtgtcctccgtaggtaaccaaacgtacgtaacccaggacaaaccgaccccaaatgatgtatttangatgtactaagtaactccgacctgtagggtttcngactcgtcttcttcgacctcgaagtctcggaccaaaccgaccgtccctacctacgaacccctntccgtcgtcggcctacccgagtaccgtagggaacggaccggagtaccgttagtaactttaactaccgtgaactcgacctacaaacgtaanaccgaaaggccggactagggtcggggttaggggtcggttccggggacggggtaacacgtacgttccggaacccgtgtacggccaacgccgaggccctccgcccgtacggtcaccgttcgcccggtttaccccccncccgttacctaccaacgtcgtcgtcgcgtcggcgtacggcg

SEQ ID NO: 344297 - DNA, 545 bp, Homo sapiens
  misc_feature: GZ8MTXP02F6ITC.10.28.C06.1.454.CMB.2.raw
  modified_base (300)..(300): a, c, t, g, unknown or other
  misc_feature (300)..(300): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaatatgaatatgtctcctggtaccaacagtaccaggcaaagccccaaactgatgatttangatgtcagtaactcgacctcgaggggtttctgatcgcttctttcgcctcaagtctggaccaacncggcctccctgaccatctcgngggctccagactgaggacgaggctagtattagttactgacagctcacatacagcgcaggcggttgggngttcggggcggggtaccacgacgtgaccgtccgtaaggtcgacgtcccaaggccgtaccgtccccgtcggtccaccgtcctcgtttcccccg

SEQ ID NO: 344298 - DNA, 574 bp, Homo sapiens
  misc_feature: GZ8MTXP02FHSIJ.10.28.C06.1.454.CMB.2.raw
  modified_base (253)..(253): a, c, t, g, unknown or other
  misc_feature (253)..(253): n is a, c, g, or t
  modified_base (308)..(308): a, c, t, g, unknown or other
  misc_feature (308)..(308): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (452)..(452): a, c, t, g, unknown or other
  misc_feature (452)..(452): n is a, c, g, or t
tcagcatagtagtgcacgaccggtgctcgatttagagctcacgtattgggtttggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaaataatgaaatntgtctcctggtaaccaacagtaccccaggcaaacgcccccaaactgatgatttangatgtcagtaaatccgaaccctgacggggtttctgtatcgtctttcttccgcccttccaagtctggccaacgccgcctccctgaccctntctcgtcggtaccncgagacgtagacggacgagtctagtattactacgtgacacnctcacacacgagcgcgaggtggtgggtggtcgggcggggaccgacgacgtacgtaccgtaccgtacgtacgaccgaccgaccgccgtccgtccccgtccgtcctacctccgtcccgtccccg

SEQ ID NO: 344299 - DNA, 665 bp, Homo sapiens
  misc_feature: GZ8MTXP02GWSX3.10.28.C06.1.454.CMB.2.raw
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccaccagttacattggtaataatgaatatgtctcctggtaccaacagtacccaggacaaacgcccccaaactgatgatttangatgtcagtaatcgacctcgtaggggttctgatcgctttcttcgctcagtctgacaacncggcctcctgaccatcctcgtcgggcctaccgagtacgtaggacgggacgaggtcgtaggtaatttacttacgtgacgacgtcctacctaacaacgttaaccgaaacgggtcccgggacgtaaacggggttcgggggttttacgggggttcgggttaccggggggaccggggggtaacccaacggtaccggttaccggtaaccccggttaccggtaacgggtaccgaaccggaccccgaaacgggccgttacccggcccccgttacggtaccctaccttcccgtcccgtttccccccg

SEQ ID NO: 344300 - DNA, 715 bp, Homo sapiens
  misc_feature: GZ8MTXP02JE0OA.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcgttgggttttccttgttgcttattttagaggtgtcggtgtgaggtgcagcgtgggtgggagggtcggggggaggtcgttgggtacgaggtccggtcggggggtccctggacgactcctccgtgtgtagcgtcgtggatcactattcagttattatagctagtagacgtcggggtcccgccgaggcctaccggaagggggtaacggggtcgtaggggtaggtttcgggtttacaagtttaagttattaggtaaagttaaagtaaaagttaacggtacggaaaacctaattacgttaactaagtacgacgtaacgtaactttgtaggggtacggggacggggtaccctaatttcccgaacctacgttccctacgaaagtaacgaactaaagtcgaaaccgtaaggtaacttacgtacgtagtagttaggtaaggtaaactagaaaccgtagtcgtaaggacggacggaccggaggaccgtacggtaccttcgttaacgttacgttacgtggcgaacggtaacgaaccccggtaaccggtaaaaggttccgggttaactaaacg

SEQ ID NO: 344301 - DNA, 728 bp, Homo sapiens
  misc_feature: GZ8MTXP02HLUZG.10.28.C06.1.454.CMB.2.raw
  modified_base (331)..(331): a, c, t, g, unknown or other
  misc_feature (331)..(331): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtgggagggtcggggggaggtcgttgggtacgaggtcccggttcgggggggtcccctggagacctctccgtgtgtagtcgtctggattcactattcagtagttatagcatgacgtgggtccnccgaggcctccggaggggaaggggtcgtgggaggttgggttacattatattgataagaaataggtaggaaacctagtattaactatgactaagtactcgtggtaggacggggtccgtacttaccgactacgtcctaccgaagacgaactaacgtcggaccgtaaacggtaaacgtttactaacgttaggttaagttagggttaaaggaaaagtttacggaaacgttagggtacgttaagggaacgggaaccgggtaccgggaaacgggtacccgtaacgggtacccgttacctttacgtttaacgtttaaccgttgggttaacggtaccggaacgggtaaaccccggggaaaccccggttaaaaaacggtaccgggggtttaacctttaaaaccggg

SEQ ID NO: 344302 - DNA, 630 bp, Homo sapiens
  misc_feature: GZ8MTXP02JF2YV.10.28.C06.1.454.CMB.2.raw
  modified_base (315)..(315): a, c, t, g, unknown or other
  misc_feature (315)..(315): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgcttattttagaggtgtccggtgtgaggtgcagctgggtggaggtcggggggaggcgttgggtacaggccgtggggggtccctggacgactctcctgtgtagcgtctggattcacattcagttagttatagcatgaactgggtccnccgaggctccgaggggaaggggctggagtggttcatatattgatagaatagtgaacatntactangacagactcngttgaggggccattcgacctatcctcaagtagacaaagtcgaccgaaggtaattacctaatcggttaattcggtaagggaaaacttggaaaactacggttactaggaacggaacggtcccggaaagggaaccgaccgggtaccttaccggttactttaaacgtttacccgtaggttaacggaacccggtagaaacccgggtacccccggtaaaaagttccgggggtttaaactaaaccgg

SEQ ID NO: 344303 - DNA, 550 bp, Homo sapiens
  misc_feature: GZ8MTXP02G7FFJ.10.28.C06.1.454.CMB.2.raw
  modified_base (314)..(314): a, c, t, g, unknown or other
  misc_feature (314)..(314): n is a, c, g, or t
  modified_base (419)..(419): a, c, t, g, unknown or other
  misc_feature (419)..(419): n is a, c, g, or t
  modified_base (469)..(469): a, c, t, g, unknown or other
  misc_feature (469)..(469): n is a, c, g, or t
  modified_base (514)..(514): a, c, t, g, unknown or other
  misc_feature (514)..(514): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggagcgttgggtacaggccgtggggggtccctgagactctcctgtgtagcgtctggattcactattcagtagttatagcatgaactggggtcccncgaggctcgaggggaggggctgggagttgggttacatatatgatagaaatagtaggaaccatatactatcgacagactcgtgtgggacggggcctattcacatcnccagagacaatcgaccaggaacttcacgtagtagtgtaagaaatggaacnggttcagagacgacccggaggaccacggctacgtactacttacgngtaacgacgacgacgaaccgtaagtacggtactacg

SEQ ID NO: 344304 - DNA, 678 bp, Homo sapiens
  misc_feature: GZ8MTXP02HH0YT.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtggaggtcggggggagcgttggtacaggccgtgggggtccctgagctctcctgtgtacgtctgatcacatctagtagttatagcatagtacgtacggtccggccacggcgccgaggggaaggggagtggtaggtgggtttcgtaatatagttagtaagtaagtaaacgtaagtaggtaacaacttaatactatagcaagactcgtgtgggacggggccgtacttcgacctaactcgtacccaaggacgaacaaacgtagacccgtaaaggtaaactttacctacgtttagttaaggttagtaaagggaaaagttaaggtaaaccaagttcgtacggaacggaacggaccccggaaaggaacccgccggtaacttccttaacctttaacgttacgttacggttaggaaccggtaacggaacccggaaaacccccggttaaaagtaaaccgggttacgttaaaaccggttaac

SEQ ID NO: 344305 - DNA, 673 bp, Homo sapiens
  misc_feature: GZ8MTXP02JPOIN.10.28.C06.1.454.CMB.2.raw
  modified_base (113)..(113): a, c, t, g, unknown or other
  misc_feature (113)..(113): n is a, c, g, or t
  modified_base (335)..(335): a, c, t, g, unknown or other
  misc_feature (335)..(335): n is a, c, g, or t
  modified_base (381)..(381): a, c, t, g, unknown or other
  misc_feature (381)..(381): n is a, c, g, or t
  modified_base (673)..(673): a, c, t, g, unknown or other
  misc_feature (673)..(673): n is a, c, g, or t
tcagcatagtagtgcacgaccggtgctcgatttagagctcacgtattgggtttggggagctctcagagaggtgccttagccctggattccaaggcatttcccacctggtgatnagcactgacacagaggactgaccatggagttggggctgtgctgggttttccttgttgctattttagaaggtgtccggtgtgaggtgcagctgggtgggaggtcggggggaggcttgggtacaggcccgtgggggggtccctggagactctcctgtgtagcgtctggattcactattcagtagttatagcatgaactgggtccgcaggctccgaggggagggntggagtgggttcatatatgatagaatagtagaacatatactatagnagctcgtggtggagggggtcccgattaccgacccaactctacccgaaggaacgaacgaacgtacgacccgtaagggtaacttcgtaccgttaggttaagttagggtaaggtaaaagttaaggaaaaccgtaaggttacccggtagggtaaaggaacgggtaccccggggaaaagggccggaaaacccggtccgtttaacgtaccctttaagtttaaccgtcggttaaacggaaccggggcggggaaacccccgtaaaaacccgggttaaccgggtttaaccggttaaccggn

SEQ ID NO: 344306 - DNA, 574 bp, Homo sapiens
  misc_feature: GZ8MTXP02H9I9I.10.28.C06.1.454.CMB.2.raw
  modified_base (366)..(366): a, c, t, g, unknown or other
  misc_feature (366)..(366): n is a, c, g, or t
  modified_base (504)..(504): a, c, t, g, unknown or other
  misc_feature (504)..(504): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgctcaccatggagttggggctgtgctgggttttccttgttgcttattttagaaggtgtccggtgtgaggtgcagcgtgggtgggaggtcggggggaggtcgttggtacaggccgtgggggtccctgagactctcctgtgtagcgtctggattcactattcagttagttatagcatgaacgtcgggtcccgccgaggctccgaaggggaggggcgtgggtagtggttnatatattgataagaaatagtagacatatactatgcagtctctggtggacggggcctattccaccatcctaccaagacgacaagtcgaccaggtaattcacgttagtagtggtaagaaatagaaactagtacagaacgnggaccggaggacaccggtctacgttacttaatcgtggtacgcgaagaccgtaaacccgtaaaagttcggg

SEQ ID NO: 344307 - DNA, 524 bp, Homo sapiens
  misc_feature: GZ8MTXP02GJHJ6.10.28.C06.1.454.CMB.2.raw
  modified_base (363)..(363): a, c, t, g, unknown or other
  misc_feature (363)..(363): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaagatgtccggtgtgaggtgcagctgggtggaggtcggggggagcttggtacagccgtgggggtccctgagctctcctgtgtagcgtctggattcacattcagtagttatagcatgaactgggtccgcaggctccgagggagggcctggagtgggttcatatattgatagaaatagtagaactntatactatgcaagactcgtgtggagggccgattcaccatctacagagacatagccagaacttcactgtatgtagaaatgaacgataccgtgacgacgacggaaggacgaacggctcgtactattacgtgtcgcgacgacgacccgaaaagttcggtaaccg

SEQ ID NO: 344308 - DNA, 610 bp, Homo sapiens
  misc_feature: GZ8MTXP02GUKRH.10.28.C06.1.454.CMB.2.raw
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctctggacagtccatcaccatctcctgcactggacccacagttacattggtaataatgaatatgtctctggtaccaacagtacccaggacaaacgcccccaaactgatgatttangatgtanagtatcgtacctgtaggggtttctgatcgctttcttccgcctactaagtctggacaacgccggtcctccctgacctatctcgtgggctccgagtacgtggacggtacgaggtccttagtaatttagttacgtgtactacgtctactaactaacgtaacgaaggccggacgtagggtcggggtttgggggtcgggttccggggaccgggggaaccacgacgtacggacccggtcgtaacggtcgacgcccgtaacggtccgtcccggccccgtcggtacctacgttccgtccgttcccccg

SEQ ID NO: 344309 - DNA, 562 bp, Homo sapiens
  misc_feature: GZ8MTXP02I5CYK.10.28.C06.1.454.CMB.2.raw
  modified_base (319)..(319): a, c, t, g, unknown or other
  misc_feature (319)..(319): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctatttagaagtgtccggtgtgaggtgcagctgggtggaggtcggggggagcttggtacagccgtggggggtccctgagactctcctgtgtagcgtctggattcactattcagttagttatagcatgaacgtggtccncaggctccgaggggaggctggagtggttcatatatgatagaatgagacatatactatgcagctcgtggtggaggggcctattccaactacgtctaccgaagacgaactaagtcgaccgaaggttaattccgagttagtagtaggtaggaaaattgaactagtcgtagagacggccgaaggaccacggtctcgtattagtaacgtggtacgacgtacggaccgtaacccggtaaaagttacggg

SEQ ID NO: 344310 - DNA, 649 bp, Homo sapiens
  misc_feature: GZ8MTXP02GLP79.10.28.C06.1.454.CMB.2.raw
  modified_base (391)..(391): a, c, t, g, unknown or other
  misc_feature (391)..(391): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgctattttagaaggtgtccggtgtgaggtgcgagctgggtgggaggtcggggggagcgttggtacaggccggtgggggtccctgagctctcctgtgtacgcgtctggtacttcactattcagttagttatagctatggaacgtggggtccccaccgaaggccgtaccggaagggggacggggtcgttggggtaggtttcggttactagtattagtagtaanaaagtaaagtagtaacgaacctattatactaagtcgacaagtcgtgtgggagggaccggggtacccttagtacccactactcccgtaccgaaaggacaaacgatccgaagtacgtaacttcagttagtagtagaagtaaagactacgagtcgtagaaagtccggaaccgacggtaaacggcccgtacttcgtacgttaacttacggtcggaacgtaaccggaagtaaccccgaacggtaaaagtccgtagtaaacccg

SEQ ID NO: 344311 - DNA, 623 bp, Homo sapiens
  misc_feature: GZ8MTXP02HIYZP.10.28.C06.1.454.CMB.2.raw
  modified_base (395)..(395): a, c, t, g, unknown or other
  misc_feature (395)..(395): n is a, c, g, or t
  modified_base (572)..(572): a, c, t, g, unknown or other
  misc_feature (572)..(572): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggtgtccggtgtgaggtgcagcgtgggtggagggtcggggggaggtcgttggtacgaggccgtggggggtccctggacgactctcctgtgtagcgtctggattcactattcagtagttatagcatgaactgggtcccgccgaggctccgaggggaagggcgtggaggttgggttacatatatgataagaaatagtagaaacctatatactancgacagtctcgtggtaggacggggcctaattccgaactacttcaccgaagacgacaacgtcgaaccgaaggttaaacttccgtaagttgttaagttaggtaagtaaaagttagaaacgtaaggttcagggaaagaccggacggaaggtaccgaccggtctccgtacgttaccttagngtcggaacgacggtaacccgaacccggtaaaaggtacgggttactaaaccg

SEQ ID NO: 344312 - DNA, 700 bp, Homo sapiens
  misc_feature: GZ8MTXP02HNQRW.10.28.C06.1.454.CMB.2.raw
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
tcagcatagtagtgcacgaccggtgctcgatttagagctcacgtattgggtttggggagctctcagagaggtgccttagccctggattccaaggcatttcccacctggtgatcagcactgaacacagaggactcaccatggagttggggctgtgcgttgggtttttccttgttgtcttattttagaaggttgtccggtgtgaggtgcagctgggtgggagggtcggggggagtcgttgggtacaggtccggtgggggtccctgagtacttcctcctgtgtagcgtctggtattcaatnttctagttagttatagacagtagacgtcgggtaccnccgaggccgtcggagggggaacgggtcgttagggtaggtttggggtttactaagttagttacgttagtaaataaaggtaaacgttagggttaggaaaccttaattacgtaccttaagttcgaacgtaagtaccgttacggttaggtacggggacgggggtaccctagttacccaacctcgttaccacccgaagaaaccgtactaacgtcggaacccgtaggtaactttacgtacttaggttaagtaggtaagaaagtcgaaaccgtagttccgaggacgacggaccgaggaccgaccgtacttctatacgtttacgcgttcgacgacggtacccggaaacccgtaaagggtaccgttacttaaacg

SEQ ID NO: 344313 - DNA, 624 bp, Homo sapiens
  misc_feature: GZ8MTXP02FPW45.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcttggtacaggccgtggggggtccctgagactctcctgtgtagcgtctggattcactattcagtagttatagcatgaactgggtccgcaggctcgaggggagggcgtggagtggttcatatatgatagaaatagtgaacatatactatgacagactcgtgtggaggggaccgattcaaccatactacagagacaagtgaccgtaggaaacttcacgttagtaagttaggtaaggtaaaatacgaaacgtacggtacgttaggaacggacggaacccgggtaagggaaaccggtaccgggtaccttaccgttacctttaaaagttccgttggtaacggaccggtaaggtaacccggaaacccccggtaaaaaggttaccggggttaaccgttaaaaccgg

SEQ ID NO: 344314 - DNA, 571 bp, Homo sapiens
  misc_feature: GZ8MTXP02F8HGM.10.28.C06.1.454.CMB.2.raw
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
tcagcatagtagtgcacgaccggtgctcgatttagagctcacgtattgggtttgggggagctctcagagaggtgccttagccctggattccaaggcatttccacctggtgatcagcactgaacacagaggactcaccatggagttggggctgtgctgggttttcctgttgctattttagaaggtgtccggtgtgaggtgcagctgggtgggagggtcggggggaggcgttgggtacaggcccggtggggggtccctgagactctcctgtgtagcgtctggattcatattcaagttagttatagcatgaacgtgggtccncgaggctcgaggggagggctggagttggttcatatatgatagaaatgaggaacatatactatgcagactgtgtggacggggccattccacctntacctccaagagaacaagtcgaccgaaaggtattcactgtagaggtaacgaaatacggaaactaaggtcaaggacgacgaccgagggaccacggtcttactacttacgttactgggcgacggaacgaaccggaaccccgaaaagtcgggtactaaaccg

SEQ ID NO: 344315 - DNA, 625 bp, Homo sapiens
  misc_feature: GZ8MTXP02JN1UM.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctatttagaggtgtccggtgtgaggtgcagctgggtgggagggtcggggggaggtcgttgggtacaggccgtggggggtccctgacgactctccgtgtgtagcgtctggattcactattcagttagttatagcagtgaactgggtccgccgaggcctccgaaggggaggggcgtgggaggttggggtttacatatattagataagaaataggtagaacctatatactatcgacagtacttcgtggtacgggacggggaccgtattcgaccctatcctacccgaagtaacgaacaagtcggaacctaaggtaaattccgaacgttgtaagtaggtaaagtaaataggaacgtagtcgtaggaacgacggaccggaaggaccgacggtactacgttacctagttacgtggtcgacggtaaacgaccggaaacccgtaaaagttcgggtactaaacgg

SEQ ID NO: 344316 - DNA, 603 bp, Homo sapiens
  misc_feature: GZ8MTXP02G0GM6.10.28.C06.1.454.CMB.2.raw
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
tcagcatagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaaataatgaatatgtctcctggtaccaacagtacccaggcaaagcccccaaatgatgatttangatgtcagtaancgacctntaggggtttcngatcgcttnttcgcctcaagtctggaccaacnccggtcctcctgacctatctcgtgggctaccgagactggacggacgagctagtacttattactgacagtactctacaactacgaaacgtccggaccgtaagggtccgggtttgggggtcggtttaccggggacggggggtaaccaccggtacgtacggtacccgttacgtacggttccgaacgcccgtaaacgggccttccgcccccgtcggtaccacggtcctaccggtttcccccg

SEQ ID NO: 344317 - DNA, 523 bp, Homo sapiens
  misc_feature: GZ8MTXP02FWLF2.10.28.C06.1.454.CMB.2.raw
  modified_base (308)..(308): a, c, t, g, unknown or other
  misc_feature (308)..(308): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggaggtcggggggaggcttggtacagccgtggggggtccctgagactctcctgtgtagcgtctggattcacattcagtagttatagcatgaactgggtccncaggctccgagggagggctggagtggtttcatatattgatagaaatagtaggaaccatatactatgcagactctgtgaggggccgattccaccatcctccagagacaaatcgaccaggtaacttcactgtatagtaggaaatagaacagtctagagacggccgaggacacggctctctactctgtgcgagacgacccgaaaagtacggtactacg

SEQ ID NO: 344318 - DNA, 737 bp, Homo sapiens
  misc_feature: GZ8MTXP02GLJUK.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcttgggttttccttgttgcttattttagaaggttgtccggtgtgaggtgcagctgggtgggagggtcggggggagtcgttgggtacaggtccggtgggggtccctgacgctctccgtgtgtagcgtctggattcatattcagttattatagacatgaacgtcggggtcccgcacgggctaccggagggggaacggggcgtgggtaggttgggtttacaattattagttaggaactaaagtaaagtaggtacggaaacctaatataactagtagacctaagtacgtcgttagggtcggtacgggggaccctacgttaccaacccgtacttacccgtaccgaaaggtaacgaacaacgtacgacccgtaaagggtaaactttacgtaacgttgttaaggttaggtaaggtaaaactaggtaaaccgtaaggttccgtaggaacggacggtaaccgggagggaacccgtacggggtacctttaccggtacgtttaacgtttaccgtaggggttaacggaaaccggtacggtaaaaccccgggtaaacccggtaaaaacgggttacgggttaaccgtttaaaacccgg

SEQ ID NO: 344319 - DNA, 630 bp, Homo sapiens
  misc_feature: GZ8MTXP02FX9SR.10.28.C06.1.454.CMB.2.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattgtaataatgaatatgtctctggtaccaanactaccaggcaaacgcccccaaaatgaatgaatttangtatgtacagtaaactccgacctgtaggggtttctagactcgtctttcttcgcctaccaagtctgaccaacgccggcctaccgtagaccctagtctcgtcgggtacctaccgaagtaccgtagaacggacgaaggctagtaatttatactgacagctacaacataacaaggccgagaggtcgggtttgggtcggttacgggggaccgggggaccaacggtacctcgggaccgtttaccgtacgggtaccaaaccggtcccgaaacgggtccctaccggtcccccgttacgggtaaccctaccgtccggtttcccggttaccccccg

SEQ ID NO: 344320 - DNA, 705 bp, Homo sapiens
  misc_feature: GZ8MTXP02G3P2O.10.28.C06.1.454.CMB.2.raw
  modified_base (256)..(256): a, c, t, g, unknown or other
  misc_feature (256)..(256): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctccgtggacagtccatccaccatctcctgcactcggacccacagttacattgtaaataatgaatntcgtctctacggtaccaacgtacgtacccaggacaaaaccgcccccaaaatgatagtaatttatgattagtcaagttaacgtcccgtaccgtacgttaggggtttctaggtacttccgtcttttcttcggaccctacctaagtctacggacaaccgccggtccctacacgacctcttccgcgtcgggtacctaccgacgtacgtagggaacggacgtacggtacttaggttactttaacgtacgtcgacacgtcctacgactaagacgaacggtccggagtacgggtcgggttagggggtccggttacgggggacccggggaccctaacggtaccggaccggtacccggtaacgttccgggaccgaccggtaccccgaaaccggtcccgtaaccccgggttcccccgtcggttaccctacccgttacccggtttcccgttaaccccccc

SEQ ID NO: 344321 - DNA, 578 bp, Homo sapiens
  misc_feature: GZ8MTXP02HZUC2.10.28.C06.1.454.CMB.2.raw
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (403)..(403): a, c, t, g, unknown or other
  misc_feature (403)..(403): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgttgctattttagaggtgtcggtgtgaggtgcagcgtgggtggaggtcggggggagtcgttggtacaggccgtgggggtccctggagactctcctgtgtagcgtctggattcactattcagtagttanagcatgaacgtcggtccncgaggctaccggaggggagggtctgggagttggttcattatattgatagaatagtagacatatactatgcagtctcgtgnggacgggctattccgactacgtctacgaagacgactaaagtcgaccgaaggtaacttcacgttagtaagtggtaagaaagtacgaacgtagtacgaggaacgacggtaccggacggacgaacggtctactacttagtaacgtgtacgacggaagaccgaacccgtaaaagtccgg

SEQ ID NO: 344322 - DNA, 627 bp, Homo sapiens
  misc_feature: GZ8MTXP02IEZ9W.10.28.C06.1.454.CMB.2.raw
  modified_base (312)..(312): a, c, t, g, unknown or other
  misc_feature (312)..(312): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagcgtggtggaggtcggggggaggtcgttggtacaggccgtggggggtccctgagactctcctgtgtagcgtctggatcacattcagtagttatagcatgaacgtgggtccnccgaggcctccgaggggaagggcgtgggtagttgggttcataggggtattgaataagaatagtagaaccatatactatgacagactcgtggtggacggggccgtattccacctatctacccagaacgacaatcgaccgtaaggtaacttctacgttagttagtaggtaaggaaaattagaaacgtaggttacgtaggaaacggaacggaccgggaaacggacccgaacggtccgttacttacttacgtttactcggtaacgacggaaacgtacccggaaaccccggtaaaacggttacggggttacctaaaccgg

SEQ ID NO: 344323 - DNA, 574 bp, Homo sapiens
  misc_feature: GZ8MTXP02G5FSU.10.28.C06.1.454.CMB.2.raw
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (507)..(507): a, c, t, g, unknown or other
  misc_feature (507)..(507): n is a, c, g, or t
tcagcatagtagtgcacgaccggtgctcgatttagagctcacgtattgggtttgggggagctctcagagaggtgccttagccctggattccaaggcatttccacctggtgatcagcactgaacacagaggactcaccatggagttggggctgtgcttgggttttccttgttgctattttagaggtgtccggtgtgaggtgcagcgtgggtggagggtcggggggaggtcgttgggtacgaggccgtcggggggtccctgagacttctccgtgtgtagcgtcgtggatcactattcagtagttacagcagtagaactcggggtccgccgaggccgtacgagggggaaggcgtggtaggtgggtttacattatatagtaatagaaatagtagaacatatatancanagtctgtgtgngggacctntccactatcacagacaanacgtgacaggtaactacntagtagtagaagtaaangtaaacngtactaggagacgacggaacgacnccggtactctacgttactcgttgcgaggtaacgaaacccgaaccgtaaaaggttccggtactaaacg

SEQ ID NO: 344324 - DNA, 632 bp, Homo sapiens
  misc_feature: GZ8MTXP02F5RMZ.10.28.C06.1.454.CMB.2.raw
  modified_base (194)..(194): a, c, t, g, unknown or other
  misc_feature (194)..(194): n is a, c, g, or t
  modified_base (312)..(312): a, c, t, g, unknown or other
  misc_feature (312)..(312): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttcctgttgctattttagagtgtccgtgtgaggtncagcgtggtgggaggtcggggggagtcttgggtacaggccggtggggggtccctggagtactctcctgtgtagcgtctggattcactattcagttagttatagcatgacgtgggtccncgaggcctcgaaggggaggcgtgggtaggttggttcagttatattgaataacgaaatgtacggaaacctatacgtactaatgacagtacttgtaggtagggacggggaccctattccacctatcccaccgaaggaacgaacaagtacgaccgaaggtaacttactagttagttagtaggttaaggaaagtaagtaaacgtacgttacgtagaagaacggaaccggaacgaaacgaaacggtaccgttactacttacttaccgttagttcggacggaacggaacggtaaacccggtaaaacggtaacggtacgttaaaccg

SEQ ID NO: 344325 - DNA, 639 bp, Homo sapiens
  misc_feature: GZ8MTXP02GUZ0K.10.28.C06.1.454.CMB.2.raw
  modified_base (309)..(309): a, c, t, g, unknown or other
  misc_feature (309)..(309): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggtttccttgttgctatttagaaggtgtccggtgtgaggtgcagctggtggaggtcggggggaggcgttggtacaggccgtggggggtccctggagactctcctgtgtagcgtctggattcacattcagtagttatagcatgaactgggtccncaggctcgagggagggctggagtggttcatatatgataagaaatagtagaaccatatactatgacagactcgtggtagacggggacccgtattaccacctaatcctccgagaacgaactaaagtcgaaccgaaggtaaacttcaacgttgtaagtaggtaacggtaaaagtagaaaacgtacgttagtagggaaagaaccggaacccggaaaggaaacctacggggtaccttacgttaacctttaatttaaccgttgggtcggaaccggaaacggtaaacccggaaacccccggtaaaaaaggttaccgggggttaaccctttaaaacgg

SEQ ID NO: 344326 - DNA, 670 bp, Homo sapiens
  misc_feature: GZ8MTXP02I7JH0.10.28.C06.1.454.CMB.2.raw
  modified_base (336)..(336): a, c, t, g, unknown or other
  misc_feature (336)..(336): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatgggagttggggctgtgctgggttttccttgttgctattttagaggtgtccggtgtgaggtgcagctgggtgggagggtcgggggggaggcgttgggtacgaggtcccggtgggggggtcccctggacgactcctccgtgtgtagtcgtcgtggtattcactattcgagttagttatagcatggaacgtcggggtcccncgaggcctaccggaggggaaggggcgtgggtaggttgggtttacagttaagttattaggaattaagaaataggtagaaacctatagtactatgacctagtactcgtggtgggacggggcctagttcccaacctattctacccgaagacgtaacaagtcgtaccgaaggtaacttcagttagtagtaggtaaacgaaagtagtaaactggtctaaggaaacggacggaaccgggtaagaccggaccggtacttacttaccgttaattaccggttaggaacgacggtaaacggtaacccggaaaccccggttaaaagtccggggttacttaaaacg

SEQ ID NO: 344327 - DNA, 705 bp, Homo sapiens
  misc_feature: GZ8MTXP02H60TL.10.28.C06.1.454.CMB.2.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (424)..(424): a, c, t, g, unknown or other
  misc_feature (424)..(424): n is a, c, g, or t
tcagcatagtagtgcacgaccggtgctcgatttagagctcacgtattgggtttgggggagctctcagagaggtgccttagccctggattccaaggcatttccacctggtgatcagcactgaacacagaggactcaccagtggaggttggggctggtgtcgttgggtttttccttgttgtcttattttaggaaggttggtccggtggtgaggtgcaggcgtgggtgggagggtcggggggaggtcgttgggtacgaggccggtggggggtccctgacgacttctccgtgtgngtcgtcgtgtntcatattactagtagttatagctagtggaacggttcgggcccgtaccgacggaccgtaccggaagggggacgggtacggtgggtaggttggtttactaagtagttatagaagtaaagtaaanaggttagaaccttaatagtaactaatcgacacgacgtgtaggcggggtaagggaccctacttaccgaccctagttaccgtacccgaaagaaacgacaagtacgaccgtaaggtaattccgtaagtagtagtaagggtaagaaaaagtcgtaacgtaagttcgaaggacggaacggaacccgaaacggacgtaccggtacctacgttacgttaaacgttcgttaggaacggacgtaaaacccggtacggaaaaccccgtaaaggttaacggttacgtaaaac

SEQ ID NO: 344328 - DNA, 688 bp, Homo sapiens
  misc_feature: GZ8MTXP02GKT22.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgcttgggttttccttgttgctattttagaaggtgtccggtgtgaggtgcagctgggtgggaggtcggggggaggtcttgggtacaggccgtgggggtccctgagactctccgtgtgtagcgtctggattcactattcagtagttatagcatgtaacgtcggggtcccgaccgaggtcctccggaggggaacggggtcgtggggtaacgttggggtttacaattacgttaagtttagaagttaagaaaacgttaggtagggaaccctaagtaataacgtagtgactaagtacttcgttaggtacggacgggggcctattacccaacctattccgaaccgaagacgaaactagtccgaccgtaaggtacttcctaagtgttacgaggttaggaaaattacgaacgtagtacggaagaacggacggacccggacgggaaacctaaccgggtccttaacgtcctttaagttaaccgtgttacggaacccggtaaacgaccggtaaaaccccgtaaaaggtttacccggg

SEQ ID NO: 344329 - DNA, 621 bp, Homo sapiens
  misc_feature: GZ8MTXP02JW7ET.10.28.C06.1.454.CMB.2.raw
  modified_base (291)..(291): a, c, t, g, unknown or other
  misc_feature (291)..(291): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgcgtgggttttccttgttgcttattttagaaggtgtccggtgtgaggtgcagcgtggtgggacggtcggggggagtccgttggtacgaggccgtggggggtccctggacgactctccgtgtgtgcgtctggattcactnttcgaagtagttatagcatgaacgtgggtcccgccgaggcctaccggaggggaaggggctgggagttgggtttanatatagtagataagaagtagacgaactatatactagngcagtctgtggtagggacgggactactaccacctactccgacagaacgaacacgtcgaaccgagtaactcgtacgtagtagtaagtaagtaaacgtacgaaacgtagtcgaaggacggaacggaccggaacggaccgtaccgtccttacttacgtacgtacgtacggtaacgacggaaaccgaacccgaaacccggtaaacggttacggtaactaacg

SEQ ID NO: 344330 - DNA, 620 bp, Homo sapiens
  misc_feature: GZ8MTXP02ICZB0.10.28.C06.1.454.CMB.2.raw
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgcttgggtttttccttgttgcttattttagaaggtgtcggtgtgaggtgcagctgggtgggaggtcggggggaggtcgttggtacgaggccggtcggggggtccctggacgactcctccgtggtgtagcgtcgtggtattcactattcagttagttatagcatggaacgtcggccgccaggtcctaccggaggggaaggggtctgggtagtttgggtttcaattatagttagaataagaaagttaggtacggacctattaactactagtgacagtacctgtggtggacggggtccattccaaccattcctaccgaagacgaacaaagtcgaccgtaaggtaattacacgttagtagtaggtagaaagtgaaactgtacgtagcggacgccggaagaccgacggtactcgttactattaacgtgacgtacgaacgaccgtaacccgtaaaagtaccgg

SEQ ID NO: 344331 - DNA, 800 bp, Homo sapiens
  misc_feature: GZ8MTXP02G3VXY.10.28.C06.1.454.CMB.2.raw
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctcgtgtctgggtctcctggacagtccatcaccatctcctgcactcggacccactagttacattggaatatgaatntcgtctctaggtaccaacacgtaccccaggccaaaacgacccccaaatcgatagtatttangtatgtacaagtaacgtccgacccttggtaggggtttctagacttccgtctttctttaccgcccttaccgaaagttccgtacgggaaccaaaccgtcccggggtccccttacccgtacggaaccctacgttccgtccggtcggggtaccctaccgtaacggtacgttacgggaacgggaacccgggtaggtacccgttaaggttaacgtttttaactaaacgttggaacctacggtaccttacgaactaacgtaaccggtaaaggcccggtaccggtaaggggttcgggggtttcgggggttccgggttaccggggggaaccgggggttaacccaaccggtaaccggttccgggtaaaccccgggttacggttaaacccggggtaccgaacccggggaccccgtaaacggggtccccgttacccccggtcccccggttccgggttaaccctcccgtttaacccggtttccccgtttaaccccccccg

SEQ ID NO: 344332 - DNA, 618 bp, Homo sapiens
  misc_feature: GZ8MTXP02FQ523.10.28.C06.1.454.CMB.2.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctaccctgactcagcctgcctccgtgtctgggtctcctggacagtccatcaccatcctcctgccactcggacccacagttacattggtaataatgaatntgtctctgtacaantaccaggacaacgccccaaatgatagtatttangtatgtacagtaactccgtaccgtcgtaggggtttcagtacgttcgctttcctttacggccccttaccgaagttccgtcggaccaaccgacggtcccgtcctcggaccacttcctcggtcgggtctaccgagtaccgtggaacggacgtaggactagtattagttacncgcagtctacactacacgacggcgacgnggtcgggttgggtacggtccggggacgggacctaacgacgtacggtaccgtacggtacgaccgaccgaccgacggtccgcccgtcccgtcgtacctccgtccgtcccgttccccgtaccc

SEQ ID NO: 344333 - DNA, 548 bp, Homo sapiens
  misc_feature: GZ8MTXP02HYWWX.10.28.C06.1.454.CMB.2.raw
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctggtggaggtcggggggaggcttggtacagccgtggggggtccctgagactctcctgtgtagcgtctggattcacattcagtagttatagcatgaactgggtcccgcaggctccgaggggaagggctggagtgggtttcagtatattgatagaaatagngaaccatntactatgcagactctgngngggccgattcgacctatcctccgagggacaatgaccaaggaattcacgttgtattaggtagaaaatgaactagtctggaagacggccgaacggacaaccggctactacttactacgttgtgaacgagacgaccccgaaaagtcgggtactaacggtaac

SEQ ID NO: 344334 - DNA, 711 bp, Homo sapiens
  misc_feature: GZ8MTXP02GS0GR.10.28.C06.1.454.CMB.2.raw
tcagcatagtagtgcacgaccggtgctcgatttagagctcacgtattggggtttgggggagctctcagagaggtgccttagccctggattccaaggcatttccacctggtgatcagcactgaacacagaggactcaccatggagttggggctgtgctgggttttcctgttgctatttagaggtgtccggtgtgaggtgcagcgtgggtggaggtcggggggaggtcgttgggtacaggccgtggggggtccctggagactctcctgtgtagcgtctggattcactattcaagttagttataggcagtgaaccgtggggtacccgccgagggcctccggaagggggaacggggctaggggtaggttggggtttacaagtagttattaggaataaggtaaaattacggttacggaaaccctaagttactaacgtaagtcgacgtaggtacttcgtgggtaggggacgggggtacccgtaattcccgaaccctagttacccgtaccaggaaacgtaaaccaagttcggaaaccgtaagggttaaactttccgaaacgtttaggttaacgtagggtaaacggttaaaataggtaaaccgtaaggttccgtaggaacggacggaaccggaacgtaaaccgacggttcctacgtttactacgttacgtcggtcgacgaaacggaccgaaccccgtaaaagtcgggtaaccttaacgg

SEQ ID NO: 344335 - DNA, 649 bp, Homo sapiens
  misc_feature: GZ8MTXP02GEICG.10.28.C06.1.454.CMB.2.raw
  modified_base (275)..(275): a, c, t, g, unknown or other
  misc_feature (275)..(275): n is a, c, g, or t
  modified_base (359)..(359): a, c, t, g, unknown or other
  misc_feature (359)..(359): n is a, c, g, or t
  modified_base (408)..(408): a, c, t, g, unknown or other
  misc_feature (408)..(408): n is a, c, g, or t
  modified_base (540)..(540): a, c, t, g, unknown or other
  misc_feature (540)..(540): n is a, c, g, or t
tcagcatagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctctgcactggacccaccagttacattggtaataatgaatatgtcttcctaggtaccaacagtacccgaggaccaaaccgcccctaaatgaatgtattangatgtactagtaatccgaccgtcggtagggtttcaggtactcgtctttactttcggcccttacgaagttcgtcggacctaaccnccggcccttccccgagaccccctactcgtacggtccggtctaacccggngtacgtgaaacgggcgtaggtacttagtaatttcgtaacgtcgtcacgtcgtacaacgtaacgaccgaaacggcggtacgacggtcgggttacggggttcgggtaccgggtaccgggggaccaccgtacggngtacccgtcggtacgtcgacgccgtacggtccgtcccggtccctccggtctacccgtctacccgttccccactcccgtaccaactctacgtcgtcgtacgcggcggacg

SEQ ID NO: 344336 - DNA, 616 bp, Homo sapiens
  misc_feature: GZ8MTXP02I7ENK.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagcgtggtgggaggtcggggggaggtcgttgggtacaggccggttcggggggtccctggacgactctccgtgtgtaggcgtcgtggattcacattcagttagttatagcagtgaacgtggggtccgccaggcctccggaggggaggggctgggagttgggtttcatattatgatagaaagtagtagaaccatatactatgcagtactcgtgtgggacggggtcctagtaccacctactcgtacccagaagaccatcgaccgtaggtaacttcgtacttagttagtagggttaagtaaagtacgaacgtaagttgtaggaagacggaccggacggaacgaccggtccttactcgttaactttacgtgtaacgacggtaacgacccggaacccgtaaaaggtcgggtactttaaaccg

SEQ ID NO: 344337 - DNA, 613 bp, Homo sapiens
  misc_feature: GZ8MTXP02H0AGC.10.28.C06.1.454.CMB.2.raw
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
  modified_base (371)..(371): a, c, t, g, unknown or other
  misc_feature (371)..(371): n is a, c, g, or t
  modified_base (491)..(491): a, c, t, g, unknown or other
  misc_feature (491)..(491): n is a, c, g, or t
tcagcatagtagtgcacgaccggtgctcgatttagagctcacgtattggggtttggggggaagaggaagactgacggtcctgccacaggtggtgctgggcacggtgggcactcgacacaacatttgcgctcaactgtcttgactcaccatggagttggggctgtgctgggttttccttgttgcttattttagaaggtgtcggtgtggaggtgcagcgtgggtgggagggtcggggggagtcgttgggtacacggtcccggtggggggtcccctggacgacttctccgttggtgtaggcgtctgggattcactattcagttagttanagcatgaacgtggggtcccncgaggctccggaggggagggctggngttgggttcattatattgataagtaatagtacggactatattactatgacagtactcgtggtcggacggggcgtacttaccacgtactcctacgagagacaatcgaccgtaagtaacttnacgttagtagtaggtaaggtaaatagaactagtacgaggacgacggaccggacggaccgtaacgtctacctaccttataacgtgtacgacggaacgaccgtaacccggtaaaagttaccggg

SEQ ID NO: 344338 - DNA, 617 bp, Homo sapiens
  misc_feature: GZ8MTXP02I0LYK.10.28.C06.1.454.CMB.2.raw
  modified_base (358)..(358): a, c, t, g, unknown or other
  misc_feature (358)..(358): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggaccactagttacattggtaatatgaatatgtctctggtaccaacacgtaccaggacaaacgaccccaaatgatagtatttatagatgtacagtaactccgacctcgtagggtttctagtactctctttcttcncctacagtcgtgacaccgcgccctctacgactactcgtcgtcggccttacgagtcgtcggaagtacgaggtcagttacttatacgtgacgatctacactaaacgactaacggcgcgtggtcggggttggggtccggtcgggggaaccggggaccctacggtaccgtaccggtccgtaccgttacggaccgaaccggacccgtacgggtcctccccggcccgttccggtacctccccggtctttacccccgtttaccccc

SEQ ID NO: 344339 - DNA, 818 bp, Homo sapiens
  misc_feature: GZ8MTXP02JC7HK.10.28.C06.1.454.CMB.2.raw
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactcggacccactagttacagttaggtaaataatgaattatgtcctctggtaaccaacacgtacccaggaccaaaaccgcccccaaacgtgatagtaatttagaggtactggtacctaaagtaactccggaacccttcggtaacggggttttctacggtatccgtaccgtttcgttcccgtccctacgtacgtcgtaggacccaaccgtccgggtccccttaccccgtacgaaccctacgttcccgtcgggttacggtcccttaccgaacggtaaccgtgggaaacggggtaacggacggtacgttaacgtttaacgtttacgttacccgtgtaacccgacgttaccgttaaacgtaccaacggttaaaccgaacggggacccggtcggtaaccgggggttaccggggttttaggggtcccggggttaaacccggggggcccggggtaaaccctaaaacggggttcccgttacggggtaacccccggttacggttaaccgggaccgtaacccggaccccggtaacgggtaacccggtaccccgttcccccggtacggttccctaaacccggtttccccggtttacccgtttacccccccg

SEQ ID NO: 344340 - DNA, 702 bp, Homo sapiens
  misc_feature: GZ8MTXP02HHJ73.10.28.C06.1.454.CMB.2.raw
  modified_base (209)..(209): a, c, t, g, unknown or other
  misc_feature (209)..(209): n is a, c, g, or t
  modified_base (317)..(317): a, c, t, g, unknown or other
  misc_feature (317)..(317): n is a, c, g, or t
tcagcatagtagtgcacgaccggtgctcgatttagagctcacgtattggggtttggggggggtctcaggaggcggccctctcgggacgtctccaccatggcctgggctctgctattcctcaccctcctcactcagggcacagggtcctgggcccagtctgccctgactcagcctgcctcgtgtctgggtctcctggacagtccatcacntctcctgcactcggacccacagttacagttaggtaataatgaattatcgtctcctaggtaaccaacacgtacccaggaccaaaccgacccccaaatgatagtatttangtatgcaagtaactccgacctggtagggtttctggtactcgtctttcgttccgccctactaagtctcggaccaaccgccggtccctacctacgaccctgtaccgtcggttcgggacccttacgaacggtaccgtaggggaaccggtaacggtacggtaccgttaggtaacgtttaactacgttcgaccgtacgtacctacgtaaccgtaagtaaccggacggccggtacggtaacggggttccgggggttgggggtaccgggtttaccggggggaccggggaacctaccggtaccggtacggtaccccggtacgtacgtccgaccgtacccgagggtccctcccggtccccgttacggtcctccgtcccgttcccggttcccccg

SEQ ID NO: 344341 - DNA, 734 bp, Homo sapiens
  misc_feature: GZ8MTXP02GFP6I.10.28.C06.1.454.CMB.2.raw
tcagcatagtagtgcacgaccggtgctcgatttagagctcacgtattgggtttggggagctctcagagaggtgccttagccctggattccaaggcatttccacctggtgatcagcactgaacacagaggactcaccatggagtttgggctgagctggttttccttgttgctattataaaggtgtccagtgtcaggtgaagctggtggagtcggtgggggagtcgttggtcaacgccgtgggacgggtccctagacgactctccgtgtgccagcctcgtggtacttcgcctcgtggtacttcggtacttcaaggttcgaacctactacacgtcgaccggttcgggtacccgccgacgggcctaccggagggggaacggggtcgtaggggtaggtttcggggttactaactacgttagtttactccggttaggtcgggttagtaaccgttaacctaattacgtaaacctacgacgtaacggaccttgtaggtaacgggaaacgggcctagttacccaacctactaccgtaccgaaggtaaccacccggaactaaaccggaactccaaacgttgtaaacccgtttagaacttaaacgacgaaaccccgacccgtaggacccggtaacggacccggtacggaaccgaccggggtaaaccttacttaacggttaacgtacggttaccggaacggtaaaacttaaaccccgggttacccccgtttacggtttaaaccccg

SEQ ID NO: 344342 - DNA, 567 bp, Homo sapiens
  misc_feature: GZ8MTXP02IPX2N.10.28.C06.1.454.CMB.2.raw
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaggtgtccggtgtgaggtgcagctggtggaggtcggggggaggcttgggtacaggccgtggggggtccctgagactctcctgtgtagcgtctggatcactnttcagttagtanagcatgacgtgggtccncaggctcgagggagggctggagttggttcagtatattagatagaaactagtagaacctatatactatgacagactgtagtggagggccgatcgacctagtctccagacgaacaatcggaccaggtaaattcacgtagttacgtaggtagtaaagtcgaacgtagtactggagacgaccggaggtacgacggtactctacgtattaccgtggtcgacggaacgacccggacccgtaaaaggtcgggtaacccttaaacg

SEQ ID NO: 344343 - DNA, 696 bp, Homo sapiens
  misc_feature: GZ8MTXP02F3OW0.10.28.C06.1.454.CMB.2.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (215)..(216): a, c, t, g, unknown or other
  misc_feature (215)..(216): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (494)..(494): a, c, t, g, unknown or other
  misc_feature (494)..(494): n is a, c, g, or t
tcagcatagtagtgcacgaccggtgctcgatttagagctcacgtattggggtttgggggggggtctcaggaggcggccctctcgggacgtctccaccatggcctgggctctgctattcctcaccctcctcactcagggcacagggtcctgggcccagtctgccctgactcagactcgcctccgtgtctgggtctctgacngtcatcacntcctcnncacgtcgaccactagtactagttagtaataatgaatatgtctccgtagtaaccaanacgaccagacaaaccgacccctaaagngatgtatttangtatgtactaagtactcccgtacccgttggtacggggttntacgtacgtcgtctttccttccgcctacgtaagtcgtacggaccaccgtcccggtccctacccacgtaccctagttccgtacggttcgggccttaccgacggttacgtacggaacgggcgacgggtacttaagttaacttttanaccgtggacctatacctacgaataacgtaacgcggtacggcggtgggttcgggggttcggggtcgggggtacccgggacgggggaccaacggtaccggttaccgggtaccgtacggttacgaccgaccggtacccgtaacggtccccggtacccggttcccccgtacgtcctacccgtttcccggtacccgtttaacccccc

SEQ ID NO: 344344 - DNA, 700 bp, Homo sapiens
  misc_feature: GZ8MTXP02H6AFT.10.28.C06.1.454.CMB.2.raw
  modified_base (311)..(311): a, c, t, g, unknown or other
  misc_feature (311)..(311): n is a, c, g, or t
tcagcatagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtcatcacatctcctgcactcggacccacgtagttacagttgtaataatgaatagtcgtctcctggtaccaacacgtaccaggacaacgaccccaaatcgatacgtatttangatgtactagtaatccgacctcgtaggggtttctagagttcgtctttacgttccgtaccctccgtacgttcgtacggccgtaacgaccggtcccttaccccgtacgtaaccctcgttcgtaccgttcggccctcgtaagaccgtggacgggagtacgcgtagttaacttacgtactagacttacgccgtacaaactagtaccgaaacggtccggaggtacggtacgggggtttacggggtccggggttacgggggacggggtacccgtaacgtacggtaccggtacccgggtaccgttacggtaccgacccgacccgggttaacggcccgtccccggttacccgggtacccgttctaaccccgttcggtttaccccgtttaaccccccg

SEQ ID NO: 344345 - DNA, 613 bp, Homo sapiens
  misc_feature: GZ8MTXP02H3DYS.10.28.C06.1.454.CMB.2.raw
  modified_base (306)..(306): a, c, t, g, unknown or other
  misc_feature (306)..(306): n is a, c, g, or t
tcagcatagtagtgcacgaccggtgctcgatttagagctcacgtattgggtttggggggaagaggaagactgacggtcctgccacaggtggtgctgggcacggtgggcactcgacacaacatttgcgctcaactgtcttgactcaccatggagttggggctgtgctgggttttccttgtgctattttagagtgtccggtgtgaggtgcagctgggtggaggtcggggggagtcttgggtacaggccggtggggggtccctggacgactctcctgtgtagcgtctggattcacattcagttagttanagcatagacgtggtcccgccgaggctaccgaggggaggggctgggagtgggttcatatagtgataagaaatagtaggacctatatactatagcagtactcgtggaggacggggcctacttccaaccattccgtaccaagagacaaagtcgaccgaaggtaaacttctaacttagtagtagggtacgtaaagtaaggtaacagttaccgagaacggaggaacccggagaacccggacggtcctacgttaccgttaattaaccgtagtacggaccgaacggaaccggtaaccccgtaaaaggttacggg

SEQ ID NO: 344346 - DNA, 539 bp, Homo sapiens
  misc_feature: GZ8MTXP02JJUPS.10.28.C06.1.454.CMB.2.raw
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
tcagcatagtagtgcacgaccggtgctcgatttagagctcacgtattgggtttggggagctctcagagaggtgccttagccctggattccaaggcatttccacctggtgatcagcactgaacacagaggactcaccatggagttggggctgtgctgggttttccttgttgctattttagaaggtgtccggtgtgaggtgcagctgggtgggaggtcggggggaggcgttgggtacaggccgtggggggtccctggagactctcctgtgtagcgtctggattcacattcagtagttatagcatgaactggggtcccgccaggcctccgaggggaaggggctggagtgggtttcagtatattgatagaaatagtgaaccatatactatgacagactctgtgngggccatcacatcnccagaganatgaccaggaattcactgtangtagaaatggaaactgtactgagacgacggaggaccacggctacgtctaacttcgtagtgaccgagaccgacccgaaaaagtcggggtactaaccg

SEQ ID NO: 344347 - DNA, 514 bp, Homo sapiens
  misc_feature: GZ8MTXP01ALUFI.11.27.C05.1.454.CMB.2.raw
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgagggaagggggctgggagtggggtctcatccattagtagtaatagtcgcctacagatactaacgcaagactcactgaagggccatcaccatctccagagacaacgccaagaactcactgtatctggcaaatgaaacagcctgagagccgaggacacggctgngttattacgngtgcgagnggagctatnctggaaccctgttgtcg

SEQ ID NO: 344348 - DNA, 540 bp, Homo sapiens
  misc_feature: GZ8MTXP01DHEKS.11.27.C05.1.454.CMB.2.raw
  modified_base (301)..(301): a, c, t, g, unknown or other
  misc_feature (301)..(301): n is a, c, g, or t
  modified_base (410)..(410): a, c, t, g, unknown or other
  misc_feature (410)..(410): n is a, c, g, or t
  modified_base (501)..(501): a, c, t, g, unknown or other
  misc_feature (501)..(501): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctggtcaagccgtggggggtccctgagactctcctgcgcagcctctggattcaccttcagtagtatagcatgaactgggtccncaggctccgagggaagggggctggagtgggtctcatccattagtagtaatagtcgcctacagatactaacgcaagactcactgaacgggccactcaccatcctccaganacaacgccaaagactcactgtatctaggacaaaatcgaaacagcctgagacgccgaaggacacgggctgtgttattacgttgtgcgaaggnggagtctaattaactcgtacggaaccccgtgttcgttcg

SEQ ID NO: 344349 - DNA, 525 bp, Homo sapiens
  misc_feature: GZ8MTXP01BPO1R.11.27.C05.1.454.CMB.2.raw
  modified_base (374)..(374): a, c, t, g, unknown or other
  misc_feature (374)..(374): n is a, c, g, or t
  modified_base (494)..(494): a, c, t, g, unknown or other
  misc_feature (494)..(494): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgaggggaagggggctggagtggggtctcgatccattagtagtaatagtgcctacagatactaacgcngactcactgaaggggccgactcaccatctccagagacaaacgccaaagaactcactgtatctggacaaatgaaacagccctgagagccgaggacacggctgtgttattacttgtgcgagnggagctattaatcgtggaccccgtgttgtcg

SEQ ID NO: 344350 - DNA, 523 bp, Homo sapiens
  misc_feature: GZ8MTXP01DOXMP.11.27.C05.1.454.CMB.2.raw
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctggggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccaggggaaggggctggagtggggtctcatccattagtagtaatagtgcctacagatactaacgcaagactcactgaagggccgactcaccatctccagagacaaacgccaaagaactcactgtatctggacaaatgaacagcctgagaagcccgaggacacggctgtgttatacngtgcgagnggagctattaatctgaaaccccgtaattggttc

SEQ ID NO: 344351 - DNA, 526 bp, Homo sapiens
  misc_feature: GZ8MTXP01DTXFG.11.27.C05.1.454.CMB.2.raw
  modified_base (406)..(406): a, c, t, g, unknown or other
  misc_feature (406)..(406): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtcccgcaggctccgagggaggggctggagtgggtctcatccatttagagtaatagtcgcctacagatactaacgcaagactcaactgaacggggccactcaccatctcaganacaaacgcaaagaactcactgtatctggacaaatgaacagcctgagaacgccgagacacggctgtnttatacttgtgcgagnggagtctattaactcgtcggaaccccgtaattgtttcg

SEQ ID NO: 344352 - DNA, 615 bp, Homo sapiens
  misc_feature: GZ8MTXP01DWMKP.11.27.C05.1.454.CMB.2.raw
  modified_base (445)..(445): a, c, t, g, unknown or other
  misc_feature (445)..(445): n is a, c, g, or t
  modified_base (550)..(550): a, c, t, g, unknown or other
  misc_feature (550)..(550): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaactgggtcccgccaggcctacggaggggaggggcgtggaggtgggtctcgactcctaagttagtaagtaagtagtcgacctacgagtactacgtaacgcaagactacacgtaggacgggccgactcacctatcacagacaacaaccgacaaagacncactagtactcgtacggaactaaagtacgaaacgcgtccaggacgaacggccggaacggacgaccggtgttgttagttagttaacgttggtacggcggaaagggngggaacgttaatttaaaattccgtccggtaacccgggaaccccgttaagtttcgtttttaaccgg

SEQ ID NO: 344353 - DNA, 518 bp, Homo sapiens
  misc_feature: GZ8MTXP01D21NG.11.27.C05.1.454.CMB.2.raw
  modified_base (373)..(373): a, c, t, g, unknown or other
  misc_feature (373)..(373): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgaggggaagggggctggagtggggtctcatccattagtagtaatagtgcctacagatactaacgcngactcactgaagggccgactcaccatctccagagacaacgccaagactcactgtatctgcaaatgaacagcctgagagccgaggacacgggctgtgttattacttgtgcgagnggagctattntctcgggacccctgttcgttcg

SEQ ID NO: 344354 - DNA, 649 bp, Homo sapiens
  misc_feature: GZ8MTXP01CRHOE.11.27.C05.1.454.CMB.2.raw
  modified_base (338)..(338): a, c, t, g, unknown or other
  misc_feature (338)..(338): n is a, c, g, or t
  modified_base (546)..(546): a, c, t, g, unknown or other
  misc_feature (546)..(546): n is a, c, g, or t
  modified_base (568)..(568): a, c, t, g, unknown or other
  misc_feature (568)..(568): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtggggagcctggtcaagccgtgggggtccctgagactctcctgcgcagcctctggattccaccttcagtagtatagcatgaacgtgggtcccgcgaggcctccgaaggggaagggcgtggagtgggtctnatcctattagtagtaatagtccacctaacagactaactaacgcaagacctcgaacgtaggaaacgggcccgaactccaacccattcccaccgaagaacgaacccaaaacgaccaaacgaaccttacaactataacttactagggtaactaaaattacggaaaccacgtacccgaggaacgaacggaccggaacggaaccgaccgggtnttaagggttgttagtttaacgnggttaccgggagacggaagggttagtaaccttaattaaccgtacgtaaccgggttaaccccgttaagttcgttttaaccgg

SEQ ID NO: 344355 - DNA, 526 bp, Homo sapiens
  misc_feature: GZ8MTXP01D3B18.11.27.C05.1.454.CMB.2.raw
  modified_base (362)..(362): a, c, t, g, unknown or other
  misc_feature (362)..(362): n is a, c, g, or t
  modified_base (493)..(493): a, c, t, g, unknown or other
  misc_feature (493)..(493): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaactgggtccgccaggctccgaggggaaggggctggagtgggtctcgatccattagtagtaaatagtcgcctanagatactaacgcaagactcactgaaagggccgactcacatctccagagacaaacgcaaagaactcactgtatctggacaaatgaacagcctagagacgccgagacacgggctgtgttatacttgtgcgagnggatctattctctcggaaccccgtaattgttcg

SEQ ID NO: 344356 - DNA, 579 bp, Homo sapiens
  misc_feature: GZ8MTXP01EXICK.11.27.C05.1.454.CMB.2.raw
  modified_base (366)..(366): a, c, t, g, unknown or other
  misc_feature (366)..(366): n is a, c, g, or t
  modified_base (527)..(527): a, c, t, g, unknown or other
  misc_feature (527)..(527): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtcccctgagactctcctgcgcagcctctggattcaccttcagtagtatagcatgaactgggtccgccaggctccgaggggaagggggctgggagtgggtctcatccattagtagtaaatagtcgcctanagatacctaacgcaagactcactgaaacgggccactcaccatccacagacgacaacgcaaagactcactgtatctaggacaaatcgaaacagcccgtagaggaacgcccggaaggacccacgggctaaggttgttaacgttacttggtacggcggaagggnggagtcttaaatttaacgtccgttaccggggaaaccccctgtttcggtttcg

SEQ ID NO: 344357 - DNA, 521 bp, Homo sapiens
  misc_feature: GZ8MTXP01BZ8K3.11.27.C05.1.454.CMB.2.raw
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (494)..(494): a, c, t, g, unknown or other
  misc_feature (494)..(494): n is a, c, g, or t
  modified_base (514)..(514): a, c, t, g, unknown or other
  misc_feature (514)..(514): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccncaggctccaggggaagggggctggagtggggtctcgatccattagtagtaatagtcgcctanagatactaacgcaagactcactgaagggccgactcaccatctccagagacaacgccaagaactcactgtaatctggacaaatacgaaacagcctgagacgccgaggacacggctgtgttattacttgtgcgagngagctataatctggaccctnttcgttc

SEQ ID NO: 344358 - DNA, 632 bp, Homo sapiens
  misc_feature: GZ8MTXP01EGRFH.11.27.C05.1.454.CMB.2.raw
  modified_base (465)..(466): a, c, t, g, unknown or other
  misc_feature (465)..(466): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcaccttctaagtagtatagcatagacgtcggtcccgccgacggccgtaccggagggggaggggcgtggaggtggtctcactactattagtaagtaagtacgtacgactacagactaaactacgcaacgactacacgtacggaacgggaccgacctaccaccactacctaccaacgaaacgaaccgaaaccgaacccaannacactactactacgtactactactaacgaacgaacgaacgaccgacgacggtaacggaccggaacggacggaacggtacggttacgttacgttacgttacgttacgttacggttcggacggtaaggtacgtaacgtacgtacgttacgtaacgttaaccgtaaccg

SEQ ID NO: 344359 - DNA, 540 bp, Homo sapiens
  misc_feature: GZ8MTXP01C7F25.11.27.C05.1.454.CMB.2.raw
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccgcaggctccgagggaggggctggagtgggtctcatccattagtagtaatagtcgcctacagatactaacgcaagactcactggaacgggccgactcaccatcctaccagacaaccaaacgccaaagactacactagtatctaggacaaatcgaaacagccgtgagacgccgaaggacacggtctgtgttattacnggtgcgaggnggagtctattctcgtacggaaccctgttcgtttaacg

SEQ ID NO: 344360 - DNA, 524 bp, Homo sapiens
  misc_feature: GZ8MTXP01AMFT1.11.27.C05.1.454.CMB.2.raw
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggtggagtctgggggaggcctggtcaagcctggggggtccctgagactctcctgcgcagcctctggattcaccttcagtagttanagcatgaactgggtccnccaggctccaggggaagggctggagtgggtctcgatccattagtagtaatagtgcccctanagatactacgcagaactcactgaagggccgactcaccatctccagagacaacgccaaagaactcactgtaatctagcgaaatagaacagacctgagagacgacggacgacggcgtgtgtagttatgttggngagagngntaatatcgtcgaccgactgttgttg

SEQ ID NO: 344361 - DNA, 537 bp, Homo sapiens
  misc_feature: GZ8MTXP01CIUSE.11.27.C05.1.454.CMB.2.raw
  modified_base (300)..(300): a, c, t, g, unknown or other
  misc_feature (300)..(300): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtcccnccagacctccgaggcgaggggggctgggaggtggggtggcagttatttcatatgatggaaatgtgacttctattcagactcgtgacggcatcaccgtctccagagacaattccaggcacacgctgtatctaggactaaatgaaacagcctagagagctggacgacgacgggctgttgtattcgtgtgacgaaagttctttctagtaaggaggtggaccgtaacgggggctttaacgg

SEQ ID NO: 344362 - DNA, 528 bp, Homo sapiens
  misc_feature: GZ8MTXP01DM2N3.11.27.C05.1.454.CMB.2.raw
  modified_base (372)..(372): a, c, t, g, unknown or other
  misc_feature (372)..(372): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
  modified_base (504)..(504): a, c, t, g, unknown or other
  misc_feature (504)..(504): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaagccgtggggggtccctgagactctcctgcgcagcctctggattcaccttcagtagtatagcatgaactgggtccgcaggctccgagggaggggctggagtgggtctcatccattagtagtaatagtgcctacagatactaacgcngactcacgtgaacgggccgactcaccatctccagagacaacgccaaagactcactgtatctggacaaatgaacagcctgaggaacgccgaggacacggctgtgttattacnggtgcgagngggatctaattncgtacggaccctaagttcgtttcg

SEQ ID NO: 344363 - DNA, 544 bp, Homo sapiens
  misc_feature: GZ8MTXP01D2UMV.11.27.C05.1.454.CMB.2.raw
  modified_base (337)..(337): a, c, t, g, unknown or other
  misc_feature (337)..(337): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
tcagcgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctggtcaagcctggggggtccctgagactctcctgcgcagcctctggattcaccttcagtagtatagcatgaactgggtccgccaggctccgaggggaaggggctggagtgggtctcanccttttttatagtagtaatagtcgcctacagatactaacgcaagactcactgaacggggccgactacaccatcctccaagagacaaacgtccaaagacctcactgtatctggacaaatgaacagcctagagaacgccgtaggaccacgggctgtgttattacttgtagcgaggnggagctaattnctacggaaccccgttnttcgtn

SEQ ID NO: 344364 - DNA, 533 bp, Homo sapiens
  misc_feature: GZ8MTXP01DP72G.11.27.C05.1.454.CMB.2.raw
  modified_base (372)..(372): a, c, t, g, unknown or other
  misc_feature (372)..(372): n is a, c, g, or t
  modified_base (426)..(426): a, c, t, g, unknown or other
  misc_feature (426)..(426): n is a, c, g, or t
  modified_base (457)..(457): a, c, t, g, unknown or other
  misc_feature (457)..(457): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaggggctggagtgggtctcgatccattagtagtaatagtcgcctacagatactaacgcngactcactgaacgggccgactcaccatcctccagacgaacaacgccaaagaacncactgtaatcctaggacaaatgaacagtccngagagccgtagacacggctgtgttattacgngtcgcgagnggagtctattntcgtacggaacccgtgttcgtttcg

SEQ ID NO: 344365 - DNA, 546 bp, Homo sapiens
  misc_feature: GZ8MTXP01DR2VO.11.27.C05.1.454.CMB.2.raw
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtcccgccaggcctccgaggggaagggggctgggagtggggtctcgatcctatttagtaagtaatagtcgcctacagactactaacgcaagactcactggaacgggccgactcaccatcctccagacgaacaacgccaaagaactcactgtatctggaacaaatacgaacagcctgagacgccgaggacacggntgtgttattacgttgtgcgagnggagcttaatctcgtacggacccctgttcgtttcg

SEQ ID NO: 344366 - DNA, 518 bp, Homo sapiens
  misc_feature: GZ8MTXP01DQF4Y.11.27.C05.1.454.CMB.2.raw
  modified_base (403)..(403): a, c, t, g, unknown or other
  misc_feature (403)..(403): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaactgggtccgccaggctccgagggaagggggctggagtgggtctcatccattagtagtaatagtcgcctacagatactaacgcaagactcactgaacgggccgactcaccatcnccagacacaacgccaaagaactcactgtatctggacaaatgaaacagcctgagacgcgagacacggctgtnattacngtgcgagnggagctatctcgcggaacccctgttgttcg

SEQ ID NO: 344367 - DNA, 545 bp, Homo sapiens
  misc_feature: GZ8MTXP01ERTU1.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaactgggtccgccaggctccgagggaagggggctggagtgggtctcatccattagtagtaatagtcgcctacagatactaacgcaagactcactgaaacgggccgactccaccatctccagagacaaacgaccaaagaactcactagtaatcctaggacaaaatcgaaacagcctgagacgccgagacacggctgtgttattacgttgtgcgagaggagtctattaactcgtacggaaccccgtaattcgtttaacg

SEQ ID NO: 344368 - DNA, 558 bp, Homo sapiens
  misc_feature: GZ8MTXP01CAFKL.11.27.C05.1.454.CMB.2.raw
  modified_base (302)..(302): a, c, t, g, unknown or other
  misc_feature (302)..(302): n is a, c, g, or t
  modified_base (481)..(481): a, c, t, g, unknown or other
  misc_feature (481)..(481): n is a, c, g, or t
  modified_base (517)..(517): a, c, t, g, unknown or other
  misc_feature (517)..(517): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttcctcgttgctcttttaagaggtgtccagtgtcaggtgcaactggaggagtcgtgggggaggcgtggtccagcctgggagtccctgagactctcctgtacagcctctggcttcaccttcattaccctatggcatgcacgtgggtcccnccagactccgaggccgagggggctgggaggtggggtggcagtttatttcatatgatggaaatgtgacttctattcagtactccgtagaagggccgattccaccgtctaccagacgactaattaccgaggcacacgctgtatctggacaaatcgaacagcctgagagcgtaggacggacncgggcttgttgtacttacgtggtgacgttaaagttntttaactagtaaggaggtgacggtaacgggggcgtttaacg

SEQ ID NO: 344369 - DNA, 541 bp, Homo sapiens
  misc_feature: GZ8MTXP01DJ682.11.27.C05.1.454.CMB.2.raw
  modified_base (362)..(362): a, c, t, g, unknown or other
  misc_feature (362)..(362): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgaggggaaggggctggagtgggtctcatccattagtagtaaatagtcgcctanagatactaacgcaagactcactgaacggggccgactccaccatcctaccagagacaaacgccaaagaacctcactgtaatctaggacaaatgaaacagcctgagacgccgaggacacggctgtgttatacngtgcgagnggagtctattaactcgtacggaccccgtaagttcgtttcg

SEQ ID NO: 344370 - DNA, 645 bp, Homo sapiens
  misc_feature: GZ8MTXP01DPFOC.11.27.C05.1.454.CMB.2.raw
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaactgggtcccgcaggctccgagggagggggctggagtgggtctcgatccattagtagtaatagtcgcctacagatactaacgcaagactcactggaacgggccactcaccatcnccagacacaaacgccaaagacncactgtaatctaggaactaaatacgaaacgagtacccgaggaacggaacggacccgggtaagggaacccgtaacgggggtccttaagggttacgtttaaagtttacccgttagggttacggccgggttaaaggggaggggttaaacttccgtttaaaatttaaccgttcccgggttaaacccggggaaaccccccgttgttttaacggggtttttaaccg

SEQ ID NO: 344371 - DNA, 551 bp, Homo sapiens
  misc_feature: GZ8MTXP01A6V06.11.27.C05.1.454.CMB.2.raw
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (507)..(507): a, c, t, g, unknown or other
  misc_feature (507)..(507): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccgaggctccgagggaaggggctggagtgggtctcgatccattagtagtaatagtcgcctanagatactaacgcngactcactggaacgggccactccaccatcctccagacgaccaacgccaaagacctcactgtatctggacaaatcgaacagcctaggagacgccgaggacacggctgtagttattacgttgtcggcgttaagnggacgtcttagttaactcggtacggaaccccgtgttcgtttccg

SEQ ID NO: 344372 - DNA, 557 bp, Homo sapiens
  misc_feature: GZ8MTXP01DROUY.11.27.C05.1.454.CMB.2.raw
  modified_base (501)..(501): a, c, t, g, unknown or other
  misc_feature (501)..(501): n is a, c, g, or t
  modified_base (512)..(512): a, c, t, g, unknown or other
  misc_feature (512)..(512): n is a, c, g, or t
tcagcgagagataccacgaccggtgctcgatttagacgcgatcgaagggtttggggagagaggagccttagccctggattccaaggcctatccacttggtgatcagcactgagcaccgaggattcaccatggaactggggctccgctgggtttccttgttgctattttagaaggtgtccagtgtgaggtgcagctggtggagtcgtgggggaggcctggtcaagcctggggggtccctgagactctcctgcgcagcctctggattcaccttcagtagtatagcatgaactgggtccgccaggctccgagggaaggggctgggggtggtctcgatccattagtagtaaatagtgccctacagatactacgcaagctcactgaacgggccgactcacccatctccagagacaaacgccctaaagaactcactgtaatctgacaaaatgaaaccagcctgagacgccgaaggactaaccgggtctggtaagttaattacgtggngacgaggaggngttacttaattacgtccgtaccgggacccttagttgttcgttttg

SEQ ID NO: 344373 - DNA, 543 bp, Homo sapiens
  misc_feature: GZ8MTXP01AUW4M.11.27.C05.1.454.CMB.2.raw
  modified_base (411)..(411): a, c, t, g, unknown or other
  misc_feature (411)..(411): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaggggctgggagtgggtctcgatccatttagtagtaatagtcgcctacagatactaacgcaagactcactggaacgggccgactcaccatctcaganacaacgccaaagactcactgtatctggacaaatgaacagcctgagacgccgaggacacggctgtgttattacgnggtgcggagnggacgtcgtattaacgtccgtcggttaacccccgtaagttcgtttccg

SEQ ID NO: 344374 - DNA, 527 bp, Homo sapiens
  misc_feature: GZ8MTXP01EZTI2.11.27.C05.1.454.CMB.2.raw
  modified_base (409)..(409): a, c, t, g, unknown or other
  misc_feature (409)..(409): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgaggggaaggggctggagtgggtctcatccattagtagtaatagtcgcctacagatactaacgcaagactcactggaggggccgactcaccatctacaganacaaacgccaaagaactcactgtactctaggacaaatgaaacagcctgagagccgagacacggntgtnttatacttgtgcgagnggatctattctcgtacggaaccccgtgttgttcg

SEQ ID NO: 344375 - DNA, 535 bp, Homo sapiens
  misc_feature: GZ8MTXP01B8J38.11.27.C05.1.454.CMB.2.raw
  modified_base (374)..(374): a, c, t, g, unknown or other
  misc_feature (374)..(374): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccgcaggctccgaggggaaggggctgggagtgggtctcgatccattagtagtaatagtcgcctacagatactaacgcngactcactgaagggccactcacatcaccagacacaacgccaaagaactcactgtatctaggacaaatgaaacagcctgagacgccgaggacncggctgtgttattacgngtacgcgagaggagtcgtattaacgtcgtacggaacccctgttcggtttaac

SEQ ID NO: 344376 - DNA, 536 bp, Homo sapiens
  misc_feature: GZ8MTXP01CLT7Q.11.27.C05.1.454.CMB.2.raw
  modified_base (378)..(378): a, c, t, g, unknown or other
  misc_feature (378)..(378): n is a, c, g, or t
  modified_base (490)..(490): a, c, t, g, unknown or other
  misc_feature (490)..(490): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagccgtggggggtccctgagactctcctgcgcagcctctggattcaccttcagtagtatagcatgaactgggtccgccaggcctccgaggggaagggggctgggagtgggtctcatccattagtaagtaatagtcgcctacagatactaacgcngactcactgaacgggccaactcaccatctccagagacaacgccaagaactcactgtatctaggacaaatgaaacagcctgagacgccggaagactacggctgtgttattacngtgcgagaggagtctattaatcgtcggaaccccgtgttcggtttcg

SEQ ID NO: 344377 - DNA, 523 bp, Homo sapiens
  misc_feature: GZ8MTXP01BB8LR.11.27.C05.1.454.CMB.2.raw
  modified_base (375)..(375): a, c, t, g, unknown or other
  misc_feature (375)..(375): n is a, c, g, or t
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgaggggaagggggctggagtgggtctcatccattagtagtaatagtcgcctacagatactaacgcngactcactgaagggccgactcaccatctccagacgacaacgccaaagactcactgtatctggcaaatgaacagcctgagacgcgaggacacggctgtgttatacttgtgcgagngagctattctcgtcggaaccccgtgttcgtttcg

SEQ ID NO: 344378 - DNA, 550 bp, Homo sapiens
  misc_feature: GZ8MTXP01EA86U.11.27.C05.1.454.CMB.2.raw
  modified_base (504)..(504): a, c, t, g, unknown or other
  misc_feature (504)..(504): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaaggggctggagtgggtctcgatccattagtagtaatagtcgcctacagatactaacgcaagactcactgaacgggccgactcacatctaccagagaacaaacgccaaagaactcactgtatctaggacaaatgaaacagcctagagacgccgaaggacacggctaagtgttattacgttgtagcgaggnggagtcttaattaacttcgacgggttaacccctaagttcgtttccg

SEQ ID NO: 344379 - DNA, 563 bp, Homo sapiens
  misc_feature: GZ8MTXP01B9ZNN.11.27.C05.1.454.CMB.2.raw
  modified_base (359)..(359): a, c, t, g, unknown or other
  misc_feature (359)..(359): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctgggggtccctgagactctcctgcgcagcctctggattcaccttcagtagtatagcatgaactgggtccgccaggctccgagggaaggggctggagtgggtctcgatccattagtagtaatagtcgcctanagatactaacgcaagactcactggaacgggccgactccacccatcctaccagacgaacaaaccgaccaaagaactacacctgtactctaggacaaatacgaacagccgtagacgacggccgaggacgacggcgtgtgttattacgttgtgcgaggaggaggtaacttattaacgtcgtacggaaccccgtaagttcgtttaacg

SEQ ID NO: 344380 - DNA, 532 bp, Homo sapiens
  misc_feature: GZ8MTXP01BZSKB.11.27.C05.1.454.CMB.2.raw
  modified_base (369)..(369): a, c, t, g, unknown or other
  misc_feature (369)..(369): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
  modified_base (522)..(522): a, c, t, g, unknown or other
  misc_feature (522)..(522): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctgattcaccttcagtagtatagcatgaacgtggtcccgcaggctcgagggaggggctggagtgggtctcatccattagtagtatagtcgcctacagatactaacgcngactcactgaacgggccactcaccatcctaccagacacaaaccgccaaagacctcactgtatctggacaaatgaacagcctgagacgccgagacgacgctgtgttatacgttgngcggagngggagtcttattaacgtcgtacggaacccctnttgtttaacg

SEQ ID NO: 344381 - DNA, 542 bp, Homo sapiens
  misc_feature: GZ8MTXP01C6C4V.11.27.C05.1.454.CMB.2.raw
  modified_base (429)..(429): a, c, t, g, unknown or other
  misc_feature (429)..(429): n is a, c, g, or t
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaagccgtggggggtccctgagactctcctgcgcagcctctggattcaccttcagtagtatagcatgaactgggtccgcaggctccgagggaagggggctggagtggggtctcatccattagtagtaatagtcgcctacagatactaacgcaagactcactggaacgggccgactcaccatctccagagacaacgccaaagaacncactgtatctggacaaatgaaacagcctagagacgccgaggacacggctgtcgttattacttgtgcgaggnggagtctattaactcgtacggaaccccgtaagttcgtttaag

SEQ ID NO: 344382 - DNA, 546 bp, Homo sapiens
  misc_feature: GZ8MTXP01CB7Z9.11.27.C05.1.454.CMB.2.raw
  modified_base (363)..(363): a, c, t, g, unknown or other
  misc_feature (363)..(363): n is a, c, g, or t
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctggtcaagcctggggggtccctgagactctcctgcgcagcctctggattcaccttcagtagtatagcatgaactgggtccgccaggctccgaggggaagggggctgggagtgggtctcatccattagtagtaatagtcgcctanagatactaacgcaagactcacgtgaagggccgactccaccatcctaccagacgacaaaccgaccaaagaacctcactgatcctaggacaaatagaacacgccctgagacgccgaggacncggctgtgttattacgngtgcgaggnggagtctaattctcgtacggaaccccgtgttcgtttcg

SEQ ID NO: 344383 - DNA, 529 bp, Homo sapiens
  misc_feature: GZ8MTXP01CHFFM.11.27.C05.1.454.CMB.2.raw
  modified_base (360)..(360): a, c, t, g, unknown or other
  misc_feature (360)..(360): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtcccgccaggctccgaggggaagggggctgggagtgggtctcatccattagtagtaatagtgcctanagatactaacgcaagactcactgaaggccgactcaccatctccagagacaacgccaaagaactcactgtatctggcaaatgaacagcctagagagccgaggacacggctgtgttattacngtgcgaggnggagctattaacgtctacggaaccccgtaagttcgtttcg

SEQ ID NO: 344384 - DNA, 526 bp, Homo sapiens
  misc_feature: GZ8MTXP01BNUSC.11.27.C05.1.454.CMB.2.raw
  modified_base (372)..(372): a, c, t, g, unknown or other
  misc_feature (372)..(372): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccgccaggctccgagggaaggggctggagtgggtctcatccattagtagtaatagtcgcctacagatactaacgcngactcactgaagggccgactcaccatcctcagagacaaacgccaagaactcactgtatctggacaaatgaaacagcctagagacgccgaggacacggctgtgttattacngtgcgagnggagtctattaatcgtcggaaccccgtgttcgttcg

SEQ ID NO: 344385 - DNA, 565 bp, Homo sapiens
  misc_feature: GZ8MTXP01CXH00.11.27.C05.1.454.CMB.2.raw
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (465)..(465): a, c, t, g, unknown or other
  misc_feature (465)..(465): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtcccgcaggcctccggagggaagggggctggagtgggtctcatccattagtagtaatagtcgacctanagatacaacgacngactcacgtgaacgggccgactcaccatccaccagacaaccaacgaccaaagaacctcaactgtaactctaggaccaaatacgaaacncgacctagacggaacgccgaaggaccacgggctaagtgttattacgngtagcggaagnggancttaagttctcgaccggttaacccgtaattgtttaacg

SEQ ID NO: 344386 - DNA, 525 bp, Homo sapiens
  misc_feature: GZ8MTXP01BRQ46.11.27.C05.1.454.CMB.2.raw
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaaggggctggagtgggtctcatccattagtagtaatagtcgacctacagatactaacgcaagactcactgaacgggccgactcaccatcaccagagacaacgaccaaagactcactgtatctaggacaaatgaaacagccagagacgccgaggacacggctgtgttattacngtgcgagnggagctataactcgacggaccctgttcgttcg

SEQ ID NO: 344387 - DNA, 542 bp, Homo sapiens
  misc_feature: GZ8MTXP01BZWZC.11.27.C05.1.454.CMB.2.raw
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (516)..(516): a, c, t, g, unknown or other
  misc_feature (516)..(516): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggcggagtcgtgggggaggcctggtcaagccgtggggggtccctgagactctcctgcgcagcctctggattcaccttcagtagttatagcatgaactgggtccgccaggctccgaggggaagggctggagtgggtctcgatccattagtagtaaatagtgcccctacagataactacgacaagctcaactgaaacgggccgactcaccatcaccagagaccaaacgccaaagaactcactgatctagacaaatgaaacngccngagagccgaagaccacggctgtntaattactgttgacgagnggngttctaattacnctacggaaccccgatgttcttttaag

SEQ ID NO: 344388 - DNA, 559 bp, Homo sapiens
  misc_feature: GZ8MTXP01B8TZ5.11.27.C05.1.454.CMB.2.raw
  modified_base (432)..(432): a, c, t, g, unknown or other
  misc_feature (432)..(432): n is a, c, g, or t
  modified_base (511)..(511): a, c, t, g, unknown or other
  misc_feature (511)..(511): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtcccgccaggctccgaggggaaggggctggagtgggtctcatccattagtagtaatagtcgacctacgagatactaacgcaagactcacgtgaacgggccgactcaccatcctcaagacaacaacgaccaagaacncactgtaatcctaggacaaatcgaaacagccctggagacgccgaggacacggctgtgttattacgttgtacgcggaggnggacgtcttaagttcgtcggtacgggaaccccgtaagttcgtttccgg

SEQ ID NO: 344389 - DNA, 523 bp, Homo sapiens
  misc_feature: GZ8MTXP01BO0L1.11.27.C05.1.454.CMB.2.raw
  modified_base (439)..(439): a, c, t, g, unknown or other
  misc_feature (439)..(439): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgagggaagggggctggagtggggtctcatccattagtagtaatagtcgcctacagatactaacgcaagactcactgaacgggccgactcaccatctccagagacaacgcaagactcactgtatctgcaaatnaacagcctgagagccgaggacacggctgtgttattacttgtgcgagnggancgtattaatcgtacggaccccgtgttcgtttcg

SEQ ID NO: 344390 - DNA, 604 bp, Homo sapiens
  misc_feature: GZ8MTXP01AXQ1W.11.27.C05.1.454.CMB.2.raw
  modified_base (364)..(364): a, c, t, g, unknown or other
  misc_feature (364)..(364): n is a, c, g, or t
  modified_base (477)..(477): a, c, t, g, unknown or other
  misc_feature (477)..(477): n is a, c, g, or t
  modified_base (511)..(511): a, c, t, g, unknown or other
  misc_feature (511)..(511): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtcgggtccgccaggctccggaagggaaggggctgggagtgggtctcatccattagtagtaatagtcgcctanagatactaacgcaagactcacgtaggaacgggcccgactccacccattccaccagacgaacaaccgaccaaagacctcactgtaactctaggaactaaagtgaaacacgtccngaaggaccggccggtaacgggaccgtaaccgggnttaaggtgttaacgttacgttggacggacggaaggacgggagtaaccttaattaacgtaccggtacgggttaaacccctgttcggttttaacg

SEQ ID NO: 344391 - DNA, 557 bp, Homo sapiens
  misc_feature: GZ8MTXP01D9XSN.11.27.C05.1.454.CMB.2.raw
  modified_base (257)..(257): a, c, t, g, unknown or other
  misc_feature (257)..(257): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
  modified_base (505)..(505): a, c, t, g, unknown or other
  misc_feature (505)..(505): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcgaagccgtgggggtccctgagactcgtcctgcgcngcctctggattcaccttcagtagtatagcatgaactgggtccgcaggctccgagggaaggggctggagtgggtctcatccattagtagtaatagtcgacctacagatactaacgcngactcactgaacggggcccatcaccatcnccaganaccaacgcaaagactcaacngtaatcctaggacaaatcgaacacgccaggagacgccgagacgacgggctggtattagttaacttggtagcgaaggngggaccgtaattagttaactacgttaccgggaaaccccgtgttcggttttcg

SEQ ID NO: 344392 - DNA, 574 bp, Homo sapiens
  misc_feature: GZ8MTXP01EFCZ9.11.27.C05.1.454.CMB.2.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtcccncaggctccgaggggaagggctggagtgggtctcatccattagtagtaaatagtcgcctanagatactaacgcaagactcactagaacgggccgactcaccctatcctaccgaagacgacaaaccgccaaagacctcactgtaatctaggactaaaagtgaaacagccctagacgacgccggagtaacccgacgggtctaaggtgttaattacgttggtgacgaggagggactcttaattaacgtacgtacggaacccctaagttcgtttaacg

SEQ ID NO: 344393 - DNA, 525 bp, Homo sapiens
  misc_feature: GZ8MTXP01D4N9T.11.27.C05.1.454.CMB.2.raw
  modified_base (359)..(359): a, c, t, g, unknown or other
  misc_feature (359)..(359): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (515)..(515): a, c, t, g, unknown or other
  misc_feature (515)..(515): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgcaggctccgagggaaggggctggagtggggtctcatccattagtagtaaatagtcgcctanagatactaacgcaagactcactgaagggccgactcaccatctccagagacaacgccaagaactcactgtatctggacaaatgaaacagcctgagacgccgaggacacggctgtgttattacngtgcgagnggagctattaatctcggaaccccgtnttcgttaacg

SEQ ID NO: 344394 - DNA, 562 bp, Homo sapiens
  misc_feature: GZ8MTXP01B9EQ7.11.27.C05.1.454.CMB.2.raw
  modified_base (361)..(361): a, c, t, g, unknown or other
  misc_feature (361)..(361): n is a, c, g, or t
  modified_base (498)..(498): a, c, t, g, unknown or other
  misc_feature (498)..(498): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctggtcaagccgtggggggtccctgagactctcctgcgcagcctctggattcaccttcagtagtatagcatgaactgggtccgccaggctccgagggaaggggctggagtgggtctcatccattagtagtaatagtcgcctanagatactaacgcaagactacactggaacgggccgactccaccattccaccagacgacaaccgaccaaagaacctacactgtactctaggacaaatacgaaacagccctagagaacggccgaaggaccacggctggtnttattacgngtagcgaggnggaggtcttagttaactcgtacggaccccgtaagttcgtttaacg

SEQ ID NO: 344395 - DNA, 547 bp, Homo sapiens
  misc_feature: GZ8MTXP01CSC87.11.27.C05.1.454.CMB.2.raw
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggattcaccttcagtagtatagcatgaactgggtccgcaggctccgagggaagggggctggagtgggtctcatccattagtagtaaatagtcgcctacagaatactaacgcaagactcactggacgggccgactcacactctccagacgacaaacgaccaaagaactcactgtatcaggacaaatcgaaacagccctagacgaagccggaaggaccacggctgtagttattacgngtagcgagnggagcgtattaatcgtacggaacccctaagttcgtttcg

SEQ ID NO: 344396 - DNA, 582 bp, Homo sapiens
  misc_feature: GZ8MTXP01CHM2O.11.27.C05.1.454.CMB.2.raw
  modified_base (369)..(369): a, c, t, g, unknown or other
  misc_feature (369)..(369): n is a, c, g, or t
  modified_base (513)..(513): a, c, t, g, unknown or other
  misc_feature (513)..(513): n is a, c, g, or t
  modified_base (551)..(551): a, c, t, g, unknown or other
  misc_feature (551)..(551): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcaagccgtgggggtccctgagactctcctgcgcagcctctggattcaccttcagtagtatagcatgaacgtcgggtcccgccgaggcctccgaggggaaggggctgggagtgggtctcatcctagttagtaagtaatagtcgcctanagatactaacgcaagactcactggaacgggcgactcacctatccacaagacgaacaacgaccaaagactcactgtatctaggactaaagtgaaacacgccgtagacgagcccggtaaggaccacggtctgttaggttattacgnggtacgacggttaggagggttacaacttacgtttaacncccggtacggaaccccgttaagttcgtttcg

SEQ ID NO: 344397 - DNA, 554 bp, Homo sapiens
  misc_feature: GZ8MTXP01BN6NK.11.27.C05.1.454.CMB.2.raw
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagttagtatagcatgaacgtgggtcccgccgaggcctccgaggggaaggggctggagtgggtctcatccattagtagtaatagtcgcctacagatactaacgcaagactcacgtggaacgggccgactccaccatcctcaganacaaacgaccaaagacncactgtatctgacaaatcgaacagcctagagacggccgaaggacgacggctgtgttattacttggtagcggagngggagtaacttattaacgtcgtacgggaacccctgttcgtttaacg

SEQ ID NO: 344398 - DNA, 553 bp, Homo sapiens
  misc_feature: GZ8MTXP01CCXM0.11.27.C05.1.454.CMB.2.raw
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaagggggctggagtgggtctcatccattagtagtaatagtcgcctanagatactaacgcngactcactgaacgggccgactcacatctcagacacaacgcaaagactcactgtatctggacaaatgaaactgccctggacgacgccgaaggacacgggctggttagttactttacgnggtacgcggaaggngggagtccttattaacgtcgtacgggaacccctaagttcgtttaaccg

SEQ ID NO: 344399 - DNA, 523 bp, Homo sapiens
  misc_feature: GZ8MTXP01CIOCT.11.27.C05.1.454.CMB.2.raw
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaagggggctgggagtgggtctcatccattagtagtaatagtcgcctanagatactaacgcngactcactgaacgggccgactcaccatcncagagacaacgccaagactcactgtatctaggcaaatgaaacagcctgagagccgaggacacggctgtgttatacttgtgcgagnggagctattctctacggaaccccgtaattgttcg

SEQ ID NO: 344400 - DNA, 616 bp, Homo sapiens
  misc_feature: GZ8MTXP01BQ25O.11.27.C05.1.454.CMB.2.raw
  modified_base (479)..(479): a, c, t, g, unknown or other
  misc_feature (479)..(479): n is a, c, g, or t
  modified_base (561)..(561): a, c, t, g, unknown or other
  misc_feature (561)..(561): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttcctgttgctatttagaaggtgtccagtgtgaggtgcagctggtggagtcgtgggggagcctggtcaagccgtgggggtccctgagactctcctgcgcagcctctgattcaccttcagtagtatagcatgaacgtcgggtcccgcgaggcctccggaaggggaaggggcgtgggagtgggtctcatccattagtagtaatagtcgcctacagatacgtaacgcaagactcgactaggaacgggcccgactccaaccatctaccaagaacgaacaaacgaccaaagaacctacactgtaactctaggaactaaaagtcgaaaccgngacccgtagaacggacgacccggtaaggaccgaaccggtgttaaggtagtttaacgttacgttggtacggacggttaagggnggttacgtcgttaattaacgtccggtaccggaaccccgtaagtttcggtttaacg

SEQ ID NO: 344401 - DNA, 557 bp, Homo sapiens
  misc_feature: GZ8MTXP01CI0UZ.11.27.C05.1.454.CMB.2.raw
  modified_base (495)..(495): a, c, t, g, unknown or other
  misc_feature (495)..(495): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaaggggctggagtgggtctcatccattagtagtaatagtcgcctacagatactaacgcaagactacactgaacgggccaactcaccatctacagacgacaacgccaaagactcactgtatctaggactaaatcgaacagtccaggagacggccgaggaccgacggctggtcgttattaacgnggtacggcgaggagggacggtctaatttcgtacgttacggaaccccgtaagttcgtttaacg

SEQ ID NO: 344402 - DNA, 573 bp, Homo sapiens
  misc_feature: GZ8MTXP01B5N9E.11.27.C05.1.454.CMB.2.raw
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (514)..(514): a, c, t, g, unknown or other
  misc_feature (514)..(514): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaaggcctggggggtccctgagactctcctgcgcagcctctggattcaccttcagtagtatagcatgaactgggtcccgccaggctccgaggggaaggggctggagtgggtctcatcctattagtagtaatagtcgcctacagactactaacgccaagactacacgtggaacgggcccgaactccacccatccncagacgacaacgcctaaagacctcactagtatactggacaaatcgaaacngcctggaanacggcccgagggtaccacgggcttaagggtattattacgnggtacggcggagngggttanttaattaactcgtacgggaacccctgttcggtttaaccg

SEQ ID NO: 344403 - DNA, 571 bp, Homo sapiens
  misc_feature: GZ8MTXP01A6DJ6.11.27.C05.1.454.CMB.2.raw
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctggggttttccttgttgctattttagaaggtgtccagtgtgaggtgcagctggtggagtctgggggaggcctggtcaagcctgggggtccctgagactctcctgcgcagcctctggattcaccttcagtagtatagcatgaactgggtccgcaggctccgaggggaagggggcgtggaggtgggtcgtcatccattagtagtaatagtgcctacagatactaacgcngactcactagaggggccgactcaccatctcaganacaacgcaagactcatgtatctagacaatagaacacgctagaacggacggaccggaaggaccgacggtcgtggttagttacgttacgttggtacggacgggaagggcggaagtaaccttaagttaacgtccggtaccgggttaaccccgtaagtttcggttcg

SEQ ID NO: 344404 - DNA, 535 bp, Homo sapiens
  misc_feature: GZ8MTXP01AI7TR.11.27.C05.1.454.CMB.2.raw
  modified_base (376)..(376): a, c, t, g, unknown or other
  misc_feature (376)..(376): n is a, c, g, or t
  modified_base (447)..(447): a, c, t, g, unknown or other
  misc_feature (447)..(447): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgaggggaagggggctgggagtggggtctcatccattagtagtaaatagtcgcctacagatactaacgcngactcactgaagggccgactcaccatctcagagacaacgcaaagactcactgtatcaggcaaatcgaaacngcctgaagagcccgaggacacgggctgtcgttatacngtgcggagngggagtctacgtttntcgtcggaacccccgtaagttcgttcg

SEQ ID NO: 344405 - DNA, 541 bp, Homo sapiens
  misc_feature: GZ8MTXP01EORSE.11.27.C05.1.454.CMB.2.raw
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
  modified_base (483)..(483): a, c, t, g, unknown or other
  misc_feature (483)..(483): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggagccgtggtcaagccgtggggggtccctgagactctcctgcgcagcctctggattcaccttcagtagtatagcatgaactgggtccgccaggctccgagggaaggggctggagtgggtctcatccatttagagtaaatagtgcctacagatactaacgcaagactcactagaacgggcccgaactcaccatccncagagaacaaacgccaaaanactacactatatcacgaactaaatacgaacacgcgagacgacgacgagacgacgngtaagtgttatacgttgtagagaggngatntagtaacgtcgacggttacctgttgttg

SEQ ID NO: 344406 - DNA, 535 bp, Homo sapiens
  misc_feature: GZ8MTXP01EQ9W7.11.27.C05.1.454.CMB.2.raw
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (443)..(443): a, c, t, g, unknown or other
  misc_feature (443)..(443): n is a, c, g, or t
  modified_base (490)..(490): a, c, t, g, unknown or other
  misc_feature (490)..(490): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagcctggggggtccctgagactctcctgcgcagcctctggattcaccttcagtagtatagcatgaactgggtccgcaggctccgagggaaggggctggagtgggtctcatccattagtagtaatgtcgcctanagatactaacgcngactcactgaagggccgactcaccatctccagacgacaaccgcaaagactcactgtatctaggacaaatgaacngcctagagacgccgaggacacggctgtgttattacgttgtgcggagnggagtcttaagttctacgtacggaaccccgtgttggttttaaccg

SEQ ID NO: 344407 - DNA, 521 bp, Homo sapiens
  misc_feature: GZ8MTXP01A601B.11.27.C05.1.454.CMB.2.raw
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgcaggctccgaggggaaggggctggagtgggtctcatccatttagtagtaatagtcgcctacagatactaacgcaagactcactgaacgggcactcaccatctccaganacaacgccaagactcactgatcnggacaaatgaaacngcctgagagccgaggacacggntgtnttatacngtcgcgagnggagtctattaatcgtcgggaacccctnttcgttcg

SEQ ID NO: 344408 - DNA, 527 bp, Homo sapiens
  misc_feature: GZ8MTXP01D7FO5.11.27.C05.1.454.CMB.2.raw
  modified_base (374)..(374): a, c, t, g, unknown or other
  misc_feature (374)..(374): n is a, c, g, or t
  modified_base (486)..(486): a, c, t, g, unknown or other
  misc_feature (486)..(486): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgagggaaggggctggagtggggtctcgatccatttagtagtaatagtcgcctacagatactaacgcngactcactgaagggcgactcaccatctccagagacaacgccaaagactcactgtatctggacaaatgaacagcctgagagcgagacacggctgtgttatacgttgtgcgagnggagcgttaattaatcgtacggaaccccgtaagttgtttcg

SEQ ID NO: 344409 - DNA, 513 bp, Homo sapiens
  misc_feature: GZ8MTXP01DDK8I.11.27.C05.1.454.CMB.2.raw
  modified_base (301)..(301): a, c, t, g, unknown or other
  misc_feature (301)..(301): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgacgactctcctgcgcgagcctctggattcaccttcagtagtatagcatgaactgggtccncaggctccgaggggaaggggctgggagtggggtctcatccattagtagtaatagtcgcctacagtatactaacgcaagactcactgaacggcgactcacanctcaganacaacgcaagacncactgtatctgacaaatgaacngcctgagagccgaaggacacgggctgtgttattacgngtgngagngatntatcncgtcgacctgttgtg

SEQ ID NO: 344410 - DNA, 525 bp, Homo sapiens
  misc_feature: GZ8MTXP01C72F1.11.27.C05.1.454.CMB.2.raw
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaggggctggagtgggtctcatccattagtagtaatagtcgcctacagatactaacgcaagactcacgtgaacgggccgactcaccatcctccagagacaacgccaaagactcactgtatctaggacaaatagaacagcctagagacgccgagacncggctgtgttattacgngtgcgagnggancgttatctcgacggaccctgttcggttc

SEQ ID NO: 344411 - DNA, 975 bp, Homo sapiens
  misc_feature: GZ8MTXP01ETBEM.11.27.C05.1.454.CMB.2.raw
  modified_base (261)..(261): a, c, t, g, unknown or other
  misc_feature (261)..(261): n is a, c, g, or t
  modified_base (297)..(298): a, c, t, g, unknown or other
  misc_feature (297)..(298): n is a, c, g, or t
  modified_base (416)..(416): a, c, t, g, unknown or other
  misc_feature (416)..(416): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagtccntcgtgtatctaccttactagtagttatagacagtanncggtaaacccggttacgggggtaccccggtaccccgaacgggggtacccggtaccccgggaaacggggggtaaacgggggggtaccgggttacgggggtaacggggttacgggggttncccccgttaccgtaaacgttaacccgtaaagttttaaaggttaaaaggttaaaacgttaacggttacggtaacccgttaaaccgtaaacggtaaacgttaaaccgtaaaccggtaaccgtaaacgtaaaccgtaaccgtaaaccggttaacggggtaaaaccggggtaaccccggtaaacccgttaaccccgtaaaccccgtaaaccgttaacccgtaaccccgaaaaccgggaaaaccggaaaaccccgaaaaaccccggggtaaaccccgtaaaaaccggtaaaacccgttaaacccgttaaacccgtttaacggtttaaaccgttaaaccgttaaccggtaaaaccgtaaaaaacgttaaaccggtaaaacccggtaaaccgggtaacccggtaacgggttaaacggggaaaccggggaaaccccgggggaaaccggggtaaacccgggttaacccggggttaccggtttaacgggtttaacgggtttaaacggttttaaccggttacgggttacggggttaaccggggtaaacggggttaaacggggtaaacggg

SEQ ID NO: 344412 - DNA, 585 bp, Homo sapiens
  misc_feature: GZ8MTXP01B858Z.11.27.C05.1.454.CMB.2.raw
  modified_base (491)..(491): a, c, t, g, unknown or other
  misc_feature (491)..(491): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgttgggggtccctgagactctcctgcgcagcctctggattcaccttcagtagtatagcatgaacgtgggtcccgccaggcctccgaggggaaggggctgggagtgggtctcatccattagtagtaatagtcgacctacagatactaaccgcaagactcacgtagaacgggccgactacacctatcctaccaagacgaacaacgaccaaagacctcactgtactctaggacaaatcgaactagcctagagacgaccgaggaccncgggctggtattattacgttgtacggcgttaagggcgaacgtccgttaaattcgtaccggtacccgggttaaaccccgtgtttcggttttaacg

SEQ ID NO: 344413 - DNA, 567 bp, Homo sapiens
  misc_feature: GZ8MTXP01DW01I.11.27.C05.1.454.CMB.2.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (520)..(520): a, c, t, g, unknown or other
  misc_feature (520)..(520): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggattcaccttcagtagtatagcatgaactgggtccncaggctccgagggaggggctggagtgggtctcatcctattagtagtaatagtcgcctanagatactaacgcaagactacacgtaggacgggccgactcacccatcctaccgaagacgaaacaaccgaccaaagaactcactagtatcctagaactaaatgaaacagccagagacgaccgaaggaccacggctgtagttacttacgttgtgacggaaggnggagtcttaagttaactccggtacggaaccccgtgttcgtttaaccg

SEQ ID NO: 344414 - DNA, 507 bp, Homo sapiens
  misc_feature: GZ8MTXP01CFRNY.11.27.C05.1.454.CMB.2.raw
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgcgcagcctctggattcaccttcagtagtatagcatgaactgggtccgccaggctccgaggggaagggggctggagtgggtctcgatccattagagtaatagtcgcctanagatactaacgcngactcactgaacgggccgactcaccatctcagagacaacgacaagactcactgtatcnggacaaatgaacagcctgagagcgagacacggctgtnttntacngtaggngagngantatcncacgacctgttgtg

SEQ ID NO: 344415 - DNA, 604 bp, Homo sapiens
  misc_feature: GZ8MTXP01DYEEM.11.27.C05.1.454.CMB.2.raw
  modified_base (366)..(366): a, c, t, g, unknown or other
  misc_feature (366)..(366): n is a, c, g, or t
  modified_base (536)..(536): a, c, t, g, unknown or other
  misc_feature (536)..(536): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcacttcagtagtatagcatgaacgtcgggtcccgcaggctccgaggggaaggggcgtaggagtgggtctctatcctattagtagtaatagtcgcctanagatactaacgcaagactcactggaacggccgactcaccatcacagacgacaacgcaagactgactgtaatcctaggactaaagtcgaaacacgccgtaggacgaacggcccgggtaagaccgaccggtgtaaggttgttaaatttaacggttgttacgggcggaagggnggggttaactcctttaaaagttcgttacccggtacgggaaaacccccggttgtttaacggtttttccg

SEQ ID NO: 344416 - DNA, 609 bp, Homo sapiens
  misc_feature: GZ8MTXP01A6OXA.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaagtgtccagtgtgaggtgcagctggtggagtcgtgggggagcctggtcaagccgtgggggtccctgagactctcctgcgcagcctctggattcaccttcagtagtatagcatgaacgtcgggtcccgccgaggcctccggaggggaaggggcgtgggagtgggtctcgatcctagttagtagtaatagtcgacctacgagtactactaacgcaagactcactaggaacgggtccgactccaccatcctaccgaagaacgaacaaacgaccaaagaacctacactagtactctaggaactaaagtacgaaacgtacgcccgtagaacggacgacccggaagggaccgacgggtctggttagttacgttacgttgggtagacggaaggaggttacggtcttagttaactacggtacggaaccccgttgttcgtttaacg

SEQ ID NO: 344417 - DNA, 526 bp, Homo sapiens
  misc_feature: GZ8MTXP01BYKF7.11.27.C05.1.454.CMB.2.raw
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccgcaggctccgagggaaggggctggagtgggtctcatccattagtagtaatagtcgcctacagatactaacgcngactcactgaacgggccgactcaccatctccagagacaaacgccaaagactcactgtanctggacaaatgaaacagcctgagagccgaaggacacggctgtgttattacngtgcgagngggatcgtataatctggaaccccgtaagttcggtttc

SEQ ID NO: 344418 - DNA, 581 bp, Homo sapiens
  misc_feature: GZ8MTXP01DD950.11.27.C05.1.454.CMB.2.raw
  modified_base (360)..(360): a, c, t, g, unknown or other
  misc_feature (360)..(360): n is a, c, g, or t
  modified_base (503)..(503): a, c, t, g, unknown or other
  misc_feature (503)..(503): n is a, c, g, or t
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaaggggctggagtgggtctcatccattagtagtaatagtcgcctacngatactaacgcaagactcactggaacgggccgactcaccatcctaccagagaacaaacgccaaagaactcactgtactctaggacaaatcgaaacacgcctggagaacgccggaaggaccacgggctggtgttagtttaacgnggttaggcggaagggngggaacggtcctttaaattaacgttacgtaccgggttaaccccgtaagttcggttttaaccg

SEQ ID NO: 344419 - DNA, 583 bp, Homo sapiens
  misc_feature: GZ8MTXP01CMFJA.11.27.C05.1.454.CMB.2.raw
  modified_base (360)..(360): a, c, t, g, unknown or other
  misc_feature (360)..(360): n is a, c, g, or t
  modified_base (461)..(461): a, c, t, g, unknown or other
  misc_feature (461)..(461): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggtttcttgttgctatttagagtgtcagtgtgaggtgcagctggtggagtcgtgggggagcctggtcaaggccgtggggggtccctgagactctcctgcgcagcctctggattcaccttcagttagtatagctatgaacgtgggtccgccaggcctccggaagggaagggggctgggagtgggtctcgatccattagaagtatagtcgcctanagatactaacgcaagactcaacgtggaacgggccactccacctatcctaccagacgaacaacgaccaaagactcactgtatccgtaggacaaatcgaaacngcctgaagacgccgaggaccncggtctgttcgttaattacgnggtacggacggaaggttaggaacgttaacttaacgtttaacgtccgtaccggggttaaccccttaagttcggttttaacg

SEQ ID NO: 344420 - DNA, 596 bp, Homo sapiens
  misc_feature: GZ8MTXP01EQJLE.11.27.C05.1.454.CMB.2.raw
  modified_base (369)..(369): a, c, t, g, unknown or other
  misc_feature (369)..(369): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggaggtcgtgggggagcctggtcaagccgtgggggtccctgagactctcctgcgcagcctctgattccaccttcagttagtatagcatgaacgtcgggtcccgccaggcctccggaggggaaggggctggagtgggtctcatccattagtagtaatagtcgacctanagtactactaaacgcaagactcactgaacggggccactcaccatcaccagacaacaaccgacaaagactcgactgtaactctagaactaaagtacgaaacagtcccaggaacgacggccgtaaggaccaccgggtgtgtgttaacgttacgttggtacggcggaaagggcggttaggtaactttaaagtcttccggtacccggaaaccccgttgtttcgttttaacg

SEQ ID NO: 344421 - DNA, 573 bp, Homo sapiens
  misc_feature: GZ8MTXP01B71LI.11.27.C05.1.454.CMB.2.raw
  modified_base (280)..(280): a, c, t, g, unknown or other
  misc_feature (280)..(280): n is a, c, g, or t
  modified_base (359)..(359): a, c, t, g, unknown or other
  misc_feature (359)..(359): n is a, c, g, or t
  modified_base (504)..(504): a, c, t, g, unknown or other
  misc_feature (504)..(504): n is a, c, g, or t
  modified_base (528)..(528): a, c, t, g, unknown or other
  misc_feature (528)..(528): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcacttcagtagtanagcatgaactgggtcccgcaggcctccgaggggaggggctgggagtgggtctcatcctattagtagtatagtcgcctanagatactaacgcaagacctcacgtggaaacgggcccgactccacccatccaccagacgaaccaacgaccaaagaacctcaactgtaatcccgtaggactaaaatgaaacctagcctagacgagccgaggacacgggctggtattntacgttgtacgcgaaggttacggntaacgttattaacgtccgtacggaaccccttgttcggttttaacg

SEQ ID NO: 344422 - DNA, 609 bp, Homo sapiens
  misc_feature: GZ8MTXP01ECT4W.11.27.C05.1.454.CMB.2.raw
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtccgccgaggcctccggaggggaaggggctggagtgggtctcatccattagtagtaatagtcgacctanagatactaacncaagactacacgtagaacgggccgactcaccatcacagacaacaacgaccaaagactcactagtatccgtaggaactaaagtacgaaacgacgcccgtaggaacggaaccggaccgtaacgggaccgtaacgggtcttaaggttgttaaacgtttacgttggtacggacggaagggaggttacgtaaccttaattaacgtccgtaccggaaccccgttaagttcgttttaacg

SEQ ID NO: 344423 - DNA, 668 bp, Homo sapiens
  misc_feature: GZ8MTXP01ETTY5.11.27.C05.1.454.CMB.2.raw
  modified_base (395)..(395): a, c, t, g, unknown or other
  misc_feature (395)..(395): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggctgggtcaagccgtgggggtccctgagactctcctgcgcacgcctctggattcaccttcagtagtatagcatgaactgggtccgccaggctccggaggggaagggggcgtggagtcgggggtctcatcctattagtaagtaatagtcgccttaacagtactactaacgcaagacctnactacgggaggtacccgactcacccaatcctaccaaggacaaacgaaacccgccaaataacctactacctaggttaactctagggctaagttacgaaccagaccccgttaggaacggacggaccccggaaggggtacccacgggggtccttaaggttcggtttaaattaaccggttggttacggggcccaaaagggggttaagggacgttaacccggtatttaactcccgggttaaccggggttaacccccgttaagttcggtttttaaccgg

SEQ ID NO: 344424 - DNA, 611 bp, Homo sapiens
  misc_feature: GZ8MTXP01DK9FX.11.27.C05.1.454.CMB.2.raw
  modified_base (367)..(367): a, c, t, g, unknown or other
  misc_feature (367)..(367): n is a, c, g, or t
  modified_base (548)..(548): a, c, t, g, unknown or other
  misc_feature (548)..(548): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaacgtgggtcccgccaggctccgaggggaaggggctgggagtgggtctcgatcctattagtagtaatagtcgacctanagatactaacgcaagactcacgtaggaacgggccgactaccacctatcctaccaagaacgacaaaccgaccaaagaacctacactagtactactaggaacaaatgaaacacgtccaggacgacggacccgaagggtaccacggcttggttaagttattaccgttggtaggaccggaaaggngggacgtaaccgtttaattaacgttccgtaccggttaaacccccgtaagttcgttttaaccgg

SEQ ID NO: 344425 - DNA, 555 bp, Homo sapiens
  misc_feature: GZ8MTXP01A5JM6.11.27.C05.1.454.CMB.2.raw
  modified_base (496)..(496): a, c, t, g, unknown or other
  misc_feature (496)..(496): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaagccgtggggggtccctgagactctcctgcgcagcctctggattcaccttcagtagtatagcatgaactgggtcccgcaggctccgaggggaggggctgggagtgggtctcatccaatttagtaagtaatagtcgacctacagaactactaacgcaagactacactggaacgggccgactcaccatcacagagacaacgacaaagactcactgtatctggacaaatcgaaacagtccagagacgaccgaggtacgacgctaagtgttattacgnggtcggcgaaggaggacgtcttataacgtacgtacgggaaacccctgttaacgttttcg

SEQ ID NO: 344426 - DNA, 527 bp, Homo sapiens
  misc_feature: GZ8MTXP01EN0DP.11.27.C05.1.454.CMB.2.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (451)..(451): a, c, t, g, unknown or other
  misc_feature (451)..(451): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaagggggctggagtggggtctcgatccattagtagtaaatgtcgcctacagatactaacgcaagactcactgaaacgggccgactcaccatcncaganacaaacgcaaagactcactgtatctaggacaaatgaacngcctgagagccgaggacacggctgtgttattacgngtgcgagngagtctaatctctacgggacccctaagttgttc

SEQ ID NO: 344427 - DNA, 694 bp, Homo sapiens
  misc_feature: GZ8MTXP01AHHUH.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctatttagaaggtgtccagtgtgaggtgcagctggtggagtcgtgggggaggcctggtcaagccgtgggggtccctgagactctcctgcgcagcctctggacttcacttcagttagtatagcagtagtaacgtcggtccgcgaggcctaccggaaggggacggggcgtagggtaggttcgggtctttaccttttattacgagtacgtaggtaggttacgtacctagttacgttcccgacgacggtaacccgttcccgggtcggggaccggggtacccgtacgttacccaccctactaccgtacccgaagaacgtaaaccaaaccttacgtaaaaccgaaactaccggttctttacgtttacctaactaaatacgaaactacgccgtaggaagtacgacgagtacgaccgtacggtaccgttgttacttacgtcgtggaacgaaggaggtacggccggggacccctaaacggttaaccgttcacgtaactaggtcggacggtcggttacggggaacccgaacgggtaaccccg

SEQ ID NO: 344428 - DNA, 786 bp, Homo sapiens
  misc_feature: GZ8MTXP01DTMJ7.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctgggtggagtcgtgggggaggcctggtcaagccgtgggggtccctgagactctcctgcgcagcctctggattcaccttcagtagtatagcagtgaacgtcgggtcccgccgaaggcctccggaagggggaacgggggtcgtagggggtaaggttggggttcctcgtaacttaccctaagttttaaggttaaaggttaaattacggttaccggtacccttaacgaaggtaacttaacccgtaaacccgggaacctaacggtaccttacccgaaacgttacggggaaaccgggggccccgaaacgttacccaaccctacttacccgtaccccgaaaggaaccggaaacccaaaacccggaccccaaaaacggtaacccttacccaaccgttagtaacttcgttaacggggaaacctaaaagttaccggaaaaccacggaccccgttaggaacggaaacgggcccggaaagggtaacccgaccgggtccgttaaggttagttaacgtttaccgttaggtacggacggaagggttaggacggtaacttaagtttaacgtccggtaccggaacccccgtaagtttcgtttaacg

SEQ ID NO: 344429 - DNA, 605 bp, Homo sapiens
  misc_feature: GZ8MTXP01EPJZO.11.27.C05.1.454.CMB.2.raw
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
  modified_base (554)..(554): a, c, t, g, unknown or other
  misc_feature (554)..(554): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggattcaccttcagtagtatagcatgaacgtgggtcccgccgaggcctccgaggggaaggggcgtgggagtgggtctcatcctattagtagtaatagtcgacctanagatactaacgcaagactcactggaacgggccgactcaccatccncagacacaaacgcaaagactcactgtactctaggaactaaagtacgaaacagccctaggaacgaacgggaccccggaaagggaacccgccgggtcttaaggttagtttaaacgttaccgttgggtacggacggaagggnggttacgtcttattaacgtccgtaccggaaccccgtaagttcgtttaaccg

SEQ ID NO: 344430 - DNA, 615 bp, Homo sapiens
  misc_feature: GZ8MTXP01DYM2C.11.27.C05.1.454.CMB.2.raw
  modified_base (367)..(367): a, c, t, g, unknown or other
  misc_feature (367)..(367): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatagaacgtcgggtcccgccgaggcctccgaggggaaggggcgtggagtgggtctcatccattagtagtaatagtcacctanagactactaacgcaagactacacgtaggaacgggcccgactaccaccatcctaccaagacgaaccaaaccgaccaaagacctcactgtactccgtagaactaaatacgaaacaggccctaggacgaacggccggaaggaccgacgggtctaaggttgttaattacgttggtacggacggttaaggagggttacgtaacttaagttaacgtccggtaacccgggttaaccccgtgtttcggttttaacg

SEQ ID NO: 344431 - DNA, 574 bp, Homo sapiens
  misc_feature: GZ8MTXP01A2VQS.11.27.C05.1.454.CMB.2.raw
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (464)..(464): a, c, t, g, unknown or other
  misc_feature (464)..(464): n is a, c, g, or t
  modified_base (522)..(522): a, c, t, g, unknown or other
  misc_feature (522)..(522): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaaggccgtgggggtccctgagtactctcctgcgcagcctctggattcaccttcagtagtatagcatgaacgtggtccncaggcctccgagggagggctggagtgggtctcatccattagtagtaatgtcncctanagatactaacgcaagctcacgtagaacggggccactacaccatcctacagacgactaaccgaccaaagactcactagtactctaggaacaaatacgaacagtccngagacgccgtaaggacgacggtctaagtcgttattaccgttggtacgcggaaggaggngtaacctaagttaacgtccgtaccgggaaccccgtaagttcggttttaaccg

SEQ ID NO: 344432 - DNA, 647 bp, Homo sapiens
  misc_feature: GZ8MTXP01ALTJZ.11.27.C05.1.454.CMB.2.raw
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtcccgccgaggcctccgaggggaagggggctgggaggtgggtctcatcctattagtagtaatagtcgcctanagatactaacgcaagctcacgtaggaacggggcccactccaccatcctaccagacgacaaaccgccaaagaacctcacttgtactctagggactaaagtcgaaacacgccgtaggaacggacggacccggaagggaccgaacgggtccgttaaggttagtttaaactttaccggttgggttacgggtaaccgggaagggttagggttaacggtcctttaagttttaaccgtacccgggttacccgggaaacccccgttaagtttcggtttttaaccggg

SEQ ID NO: 344433 - DNA, 567 bp, Homo sapiens
  misc_feature: GZ8MTXP01A3HY5.11.27.C05.1.454.CMB.2.raw
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagcggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgaggggagggctgggagtgggtctcatccatttagtagtaatagtcgcctacagatacaacgacaagactcatgaacggggccaactcaccctatcctaccagacaacaaccgacaaagaactcacttgatcctaggacaaagtcaaacngccctgaacgacgcccggtaaggaacncggtactgtacgttattacttggtagcggaagngggactcttaagttaactccgtacgggaacccctaagttcgtttaacg

SEQ ID NO: 344434 - DNA, 705 bp, Homo sapiens
  misc_feature: GZ8MTXP01CIBBS.11.27.C05.1.454.CMB.2.raw
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccggtcggggtcctgacgactctccgtgcgcacgcctcgtgtacttcctaccttcgaagttagtatacgactagtacgtaacgtcgggtcccgacgacggccgtaccggaagggggacgggcgtagggtaggttcgggtactactacttacctaagtttaaggttaaagtaagttacgtccgtacctaagacgtaactaaccgtaacgacaacgtacctacgacggtagggaaccgggaccgtaacctaccaacctacgttaccaacccgaaaggaaaccgaaacctaaacccgaaccgtaaaacgtacctaccagttatacgttactaacggggaaataaacgttacgaaaccgagtccgaggaacgacggacccggaagacccggtacggtctggttaattaacgttcggnggtacgnggaacggttggttactaacttagtaaccgtacgtacccggttaacgtgtttcgtttaacg

SEQ ID NO: 344435 - DNA, 587 bp, Homo sapiens
  misc_feature: GZ8MTXP01AOPCH.11.27.C05.1.454.CMB.2.raw
  modified_base (365)..(365): a, c, t, g, unknown or other
  misc_feature (365)..(365): n is a, c, g, or t
  modified_base (540)..(540): a, c, t, g, unknown or other
  misc_feature (540)..(540): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtgggggtccctgagactctcctgcgcagcctctggattcaccttcagtagtatagcatgaacgtgggtcccgccaggcctccgaggggaaggggctggagtgggtctcatccattagtagtaatagtcgacctanagtaatacgtaacgacaagactcaacgtggaacgggccgactccaactactcctacaagacgaaccaacgcccaaagacctcactgtactcgtaggacaaagtgaaactacgccctaggaagacgcccggaaggaccgacggctaaggtagttacttagttcggtggacggaggngacgtcttagttaactcggtaccgggaaccctaagttcgtttaaccg

SEQ ID NO: 344436 - DNA, 588 bp, Homo sapiens
  misc_feature: GZ8MTXP01A1PX1.11.27.C05.1.454.CMB.2.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (516)..(516): a, c, t, g, unknown or other
  misc_feature (516)..(516): n is a, c, g, or t
  modified_base (532)..(532): a, c, t, g, unknown or other
  misc_feature (532)..(532): n is a, c, g, or t
  modified_base (552)..(552): a, c, t, g, unknown or other
  misc_feature (552)..(552): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaaggccgtgggggtccctgagactctcctgcgcagcctctggattccaccttcagtagtatagcatagaacgtcgggtcccgccgagggcctaccggagggggaagggggcgtagggaggttcgggtctcactccgtattagtagtaatagtcgacctacagtatactaacgcaagactcacgtggaacgggccactcaccntaccncagacaacaacgaccaaagacctacactgtatcctaggacaaatgaacgtagcctaggaagaccggaccgacggactaccgggtntgtaacgttattacgnggtaggacgaggacggactnttagttctaccggtaccggaaccctgttggttttcg

SEQ ID NO: 344437 - DNA, 572 bp, Homo sapiens
  misc_feature: GZ8MTXP01AGY6G.11.27.C05.1.454.CMB.2.raw
  modified_base (374)..(374): a, c, t, g, unknown or other
  misc_feature (374)..(374): n is a, c, g, or t
  modified_base (454)..(454): a, c, t, g, unknown or other
  misc_feature (454)..(454): n is a, c, g, or t
  modified_base (526)..(526): a, c, t, g, unknown or other
  misc_feature (526)..(526): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggacttccaccttcagtagtatagcatgaacgtcgggtcccgccgaggcctccggaggggaagggggcgtgggaggtgggtctcatcctattagtagtaatagtcgacctanagactactaacgcaagactcgactaggaacgggccgactccaccatcctacagacacaacgacaagactcactgtactcnggacaaatcgaacacgtccgagacgacgccggaggaccgacggtctggtgttactacgttggtaggcgaggnggagtaactattaacgtcgtacggttaccccgtgttcgttttaacg

SEQ ID NO: 344438 - DNA, 572 bp, Homo sapiens
  misc_feature: GZ8MTXP01BUTB1.11.27.C05.1.454.CMB.2.raw
  modified_base (375)..(375): a, c, t, g, unknown or other
  misc_feature (375)..(375): n is a, c, g, or t
  modified_base (455)..(455): a, c, t, g, unknown or other
  misc_feature (455)..(455): n is a, c, g, or t
tcagcgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtcccgccaggctccgaggggaggggctggagtgggtctcatccattagtagtaatagtcgcctacagatactaacgcngactcactggaacggggccgactccaccatcctcagagacaacgccaaagactcactgtatctaggacaaagtcgaaacngcctgagacggccgaaggaccacgggctggtgttaaattcgttggtcgacggttaagcgggttacgaacgttatttaacgtcctaccgggaaacccccgtaagttccgtttaacccg

SEQ ID NO: 344439 - DNA, 861 bp, Homo sapiens
  misc_feature: GZ8MTXP01EZVEL.11.27.C05.1.454.CMB.2.raw
  modified_base (277)..(277): a, c, t, g, unknown or other
  misc_feature (277)..(277): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgagactctcctgcgcagcctctggacttccaccttnagttagtatagctagtacgaaccgtcgggtccccgccgagggtcctaccgggaagggggaacgggggtcgtagggggaggttcgggggtctaccgtacgttaccgtaaagtttaaggtaaagttaaagttacggtacccggtaccccttaaagaacgtaactaacccgtaaacgacgaaggtaccctaccgaacggtacgggaaaccggggtaccctaaccttacccaaaccctacttaccccgtaacccgaaaggaaacccgtaaacccgaaaacccgacccgtaaaacgtaacccctactaaccgttaaggttaacttacccgtaagggaaaccttaaaagtacgaaaaccgacgtacccgtaagggaaacggaacgggtaccccgggtaaacgggaacccgtaccggggttacgttaagggttaaggttttaaacccgttaacgggtttcgggtaaggggtaaccggggaaaacggttaagggggttacccgtttaaatttaaaccggttttaaccggtaccccggggttaaccccgggttaaaaccccgtttaacggttttcccgggtttttttaacggg

SEQ ID NO: 344440 - DNA, 552 bp, Homo sapiens
  misc_feature: GZ8MTXP01DRMRL.11.27.C05.1.454.CMB.2.raw
  modified_base (380)..(380): a, c, t, g, unknown or other
  misc_feature (380)..(380): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
  modified_base (524)..(524): a, c, t, g, unknown or other
  misc_feature (524)..(524): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagtagtatagcatgaacgagggtcccgccgaggcctccgaggggaaggggctggagtgggtctcatcctattagtaagtatagtcgacctacagtatactaacgcngacctcactaggaacgggccgactccaccatccacagaagaccaacgaccaaagactcactgtaactcgtaggaacaaatagaacngcctgagacgcgaggacacggctgtnttattacgttgtagcgaagngagtcttaagtnttccgacggttaacccctgttcgtttcg

SEQ ID NO: 344441 - DNA, 560 bp, Homo sapiens
  misc_feature: GZ8MTXP01C8LB4.11.27.C05.1.454.CMB.2.raw
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
  modified_base (496)..(496): a, c, t, g, unknown or other
  misc_feature (496)..(496): n is a, c, g, or t
  modified_base (506)..(506): a, c, t, g, unknown or other
  misc_feature (506)..(506): n is a, c, g, or t
  modified_base (521)..(521): a, c, t, g, unknown or other
  misc_feature (521)..(521): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaacgtgggtccgccaggcctccgagggaagggggcgtggagtgggtctcatcctattagtagtaatagtcgcctanagatactaacgcngactcactgaacggccgactcacctatccncagagacaacgaccaaagaacctcactgtactctaggacaaatagaacacgtccagagacggaccggaggaccgaacgggtctgggtnttacgttacngggttgcggttaggngggatctaattctcggtacggaacccgtgttccgttttg

SEQ ID NO: 344442 - DNA, 613 bp, Homo sapiens
  misc_feature: GZ8MTXP01AUEWY.11.27.C05.1.454.CMB.2.raw
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggattcaccttcagtagtatagcatgaacgtcgggtcccgccgaggctccgaggggaaggggctgggagtgggtctcactccattagtagtaatagtcgacctanagtatactaacgcaagactcactggaacgggccgactccaccatcacagacgacaacgcaaagaccncactgtatctaggacaaagtcgaaactacgcctagaacggacggacccggtaaggaaccgaccgggtcgttaaggttgttaaacgtttaccgttggtacggaccgggaaaggagggttaacggtaacttaagttaacgttaccggtaccgggaaccccgtaagttcggttttaaccg

SEQ ID NO: 344443 - DNA, 605 bp, Homo sapiens
  misc_feature: GZ8MTXP01A8GHT.11.27.C05.1.454.CMB.2.raw
  modified_base (364)..(364): a, c, t, g, unknown or other
  misc_feature (364)..(364): n is a, c, g, or t
  modified_base (476)..(476): a, c, t, g, unknown or other
  misc_feature (476)..(476): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaacgtgggtccgccaggctccgaggggaaggggctggagtgggtctcgatcctattagtagtaatagtcgacctanagatactaacgcaagactcaactggaacgggccgactcaccatctacagacgaacaaccgaccaaagaactacactacgtattcacggaacaaacgtagaaacgacgaccgngaacgacgaccggaacggaccgacgggtcttggttaagttacgttacgttggtggacggaagggttaggacgtaacgttaacttaacgtccggtaccggttaaacccccgtaagttccgttttaaccgg

SEQ ID NO: 344444 - DNA, 591 bp, Homo sapiens
  misc_feature: GZ8MTXP01DQYFZ.11.27.C05.1.454.CMB.2.raw
  modified_base (298)..(298): a, c, t, g, unknown or other
  misc_feature (298)..(298): n is a, c, g, or t
  modified_base (501)..(501): a, c, t, g, unknown or other
  misc_feature (501)..(501): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggagcctggtcaagccgtgggggtccctgagactctcctgcgcagcctctggattcaccttcagtagtatagcatgaacgtggtcccncgaggctccgagggaaggggctggagtggtctcatctattagtaagtaatagtcgacctacagtactactaacgcaacgactcgactaggaacgggccactcaccatccacagacgacaacgccaaagaactcactgtatacctaggaaaccaaagtacgaaacacgccgtaggacgaacgccggtaaggaaccaccgggttntaaggttattacgtacgttgacggacggaaggacgttacgtaacttagttaaccgtaccggtaaccggttaacccgttgttcgtttaacg

SEQ ID NO: 344445 - DNA, 743 bp, Homo sapiens
  misc_feature: GZ8MTXP01A47KL.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggcctggtcaagccgtgggggtccctgagactctcctgcgcacgcctctggattccaccttcagttagtatagcatacgaacgtcgggtcccgccgaggcctccggaagggggaaggggcgtggggtaggtcgggtctcgatacctagtttaagtaagtaactaggtacgaccctaagagtaactaccgtaacgacaacgtactaccgacgtacgggaaacgggcccgaacctccaaccctatcccgttaacccgaaggaaccgaaacccgaaaaccccgacccgtaaaagtaaccctccaacgtttgtaacttccgtaaggaacctaaaagtaccgaaacgccggtacccgtaaggaaccggaccgggaacccggtaacgggaacccgtaccggggtctttaagggttacgtttaaacgttaccgttagggtacggtaaccggaaagggttacgggttacttaacttaagtttaaccgttacccgggaacccggttaaacccccgttaagtttccgttttttaaccggg

SEQ ID NO: 344446 - DNA, 672 bp, Homo sapiens
  misc_feature: GZ8MTXP01CK6KR.11.27.C05.1.454.CMB.2.raw
  modified_base (614)..(614): a, c, t, g, unknown or other
  misc_feature (614)..(614): n is a, c, g, or t
  modified_base (652)..(652): a, c, t, g, unknown or other
  misc_feature (652)..(652): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggtattcaccttcagtagtatagcatgaacgtcggtccgcaggcgtaccgggggagggcgtggaggtggtctcacttacctaatttaggtaagttaaagtaggtcgtaccccctacgaagtactaaccgtacgaaccaagaactcaacgtaggaacggggacccgactccaaccctattcccacgaagacgaaccaaaccgtacccaaagaacctacctacgtagttaactcgtagaaacaaaagttaacggaaacctacggacccgtaagaacggacggaacccgggaaggaacccgaacggtcgttagttaacgttaaactttgtgttacggacggaaggttaaccgggnttacgtttaatacgttcccgtaccgggaaaccccgttntttcgtttccgtttttaagg

SEQ ID NO: 344447 - DNA, 589 bp, Homo sapiens
  misc_feature: GZ8MTXP01AJMP4.11.27.C05.1.454.CMB.2.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (466)..(466): a, c, t, g, unknown or other
  misc_feature (466)..(466): n is a, c, g, or t
  modified_base (514)..(514): a, c, t, g, unknown or other
  misc_feature (514)..(514): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgagactctcctgcgcacgcctctggattcaccttcagtagtatagcatgaactcgggtccnccgaggcctccgaggggaaggggctgggagtgggtctcatcctagttagtagtaatgtcncctanagactactaacgcaagctcacgtgaacgggccactcaccatccacgagacgacaaccgacaaagacctcgactgtactccgtagaacaaagtcaaaccngtccgagacggacgaccggacggacgcggtcttggtacgttattacgnggtacggacggaggacgggattaacgttagttaaccgtaccggtaccgggttaaacccctgtttccgttttaacg

SEQ ID NO: 344448 - DNA, 578 bp, Homo sapiens
  misc_feature: GZ8MTXP01ERIU8.11.27.C05.1.454.CMB.2.raw
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtcccgccgaggctaccgaggggaagggggcgtggagtgggtctcatcctattagtaagtaatagtcgctacagatactaacgcngactcactggaacgggccgactccacatctacaganaacaacgaccaaagactacactgtaatccgtaagaactaaanacgaacacgccgagaacggacggaccgtacggacgtacggtgtaagtagttattacgttggtacggacgagggaggactcgttaagttaacgtcgtaccggacccgttgtttcgttaacg

SEQ ID NO: 344449 - DNA, 538 bp, Homo sapiens
  misc_feature: GZ8MTXP01BM51S.11.27.C05.1.454.CMB.2.raw
  modified_base (359)..(359): a, c, t, g, unknown or other
  misc_feature (359)..(359): n is a, c, g, or t
  modified_base (482)..(482): a, c, t, g, unknown or other
  misc_feature (482)..(482): n is a, c, g, or t
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgactgggtccgccaggctccgaggggaggggctggagtgggtctcatccattagtagtaatagtcgcctanagatacctaacgcaagactcacgtaggaacggggccactccaccatcctacagacgacaacgaccaagaactcactgtatctggacaaatagaacagcctgacgacgcgaggacacggctgtnttatacgttgtgcgaggngagtctagttaactcgtacggaaccccgtgttcgttcg

SEQ ID NO: 344450 - DNA, 629 bp, Homo sapiens
  misc_feature: GZ8MTXP01EXV5T.11.27.C05.1.454.CMB.2.raw
  modified_base (365)..(365): a, c, t, g, unknown or other
  misc_feature (365)..(365): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggagcctggtcaagccgtgggggtccctgagactctcctgcgcagcctctgattcaccttcagtagtatagcatgaacgtgggtcccgccaggctccggagggaaggggctgggaggtgggtctcgatcctattagtagtaatagtcacctanagatactaacgcaagtactcaacgtggaacgggtccactccaaccctatcctaccaagacaaccaaaccgaccaaacgtactacactagtactctagggaacaaagtacgaaacacgcccgtaggaacggaaccggaccggaacggaccgtaaccgggtcttaaggttagttaacgttacggttggtgggaacggaggacggttagttaacgtaatttaacggtacggtaacccggttaacccgttaagtttcggttttaaccg

SEQ ID NO: 344451 - DNA, 544 bp, Homo sapiens
  misc_feature: GZ8MTXP01CWZHS.11.27.C05.1.454.CMB.2.raw
  modified_base (402)..(402): a, c, t, g, unknown or other
  misc_feature (402)..(402): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagtatagcatgaactgggcccgcgaggctccgagggaaggggctggagtgggtctcatccattagtaagtaatagtcgcctaacagaatactaaacgcaagactcactaggacgggaccgacncacctatcctacagacgacaaacgaccaaagaacctcactgtatctaggacaaatacgaacagcctagagacgcgagacgacggctgtnttatacngtcgngagnggatcgtattctcgtacggaaccctgttcgtttaacg

SEQ ID NO: 344452 - DNA, 556 bp, Homo sapiens
  misc_feature: GZ8MTXP01ACQWU.11.27.C05.1.454.CMB.2.raw
  modified_base (498)..(498): a, c, t, g, unknown or other
  misc_feature (498)..(498): n is a, c, g, or t
  modified_base (543)..(543): a, c, t, g, unknown or other
  misc_feature (543)..(543): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaacgtgggtcccgccaggctccgaggggaagggggctggagtgggtctcatccattagtagtaatagtcgacctacagatactaacgcaagactcacgtggaagggccgactcaccatcctcagagacaacgacaaagactcactgtactctaggacaaagtagaacagccctgaacgacgccgaaggaccgtacggctgtgttaattcnggtgcggttaggaggttagcttattaactcggtaccgaccccgtnttcggtttaaccg

SEQ ID NO: 344453 - DNA, 551 bp, Homo sapiens
  misc_feature: GZ8MTXP01DLH2C.11.27.C05.1.454.CMB.2.raw
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
  modified_base (504)..(504): a, c, t, g, unknown or other
  misc_feature (504)..(504): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagtagtatagcatagaactgggtccncgaggcctccgagggaaggggctggagtgggtctcatccattagtagtaatgtcncctanagatactaacgcaagactcactgaacgggcactcacatcacagagacaacgccaaagacncactgtatctgggaactaaagtnaacngcctgacgaacgcccggaggaccacggntggttagttattacgttgnggacgaaggnggttactcttaattaacgtcgtaccgggaaaccccttgttcgtttcg

SEQ ID NO: 344454 - DNA, 598 bp, Homo sapiens
  misc_feature: GZ8MTXP01BDP2P.11.27.C05.1.454.CMB.2.raw
  modified_base (361)..(361): a, c, t, g, unknown or other
  misc_feature (361)..(361): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgaggggaaggggctgggagtgggtctcatccattagtagtaatagtcgcctanagactactaacgcaagactcactgaacgggccgactccaccatctccagacgacaacgccaaagactcactgtaatcaggacaaagtcgaaaccagccctggaacgaacggccggaaacgggacctaccgggctggttacgttattaaccgttgggtacgaccggttaaggacgggttacgtaacttaaacgttaacgttcgtaccgggaaacccccgtaagtttcggttttaaccg

SEQ ID NO: 344455 - DNA, 659 bp, Homo sapiens
  misc_feature: GZ8MTXP01EFUUA.11.27.C05.1.454.CMB.2.raw
  modified_base (279)..(279): a, c, t, g, unknown or other
  misc_feature (279)..(279): n is a, c, g, or t
  modified_base (371)..(371): a, c, t, g, unknown or other
  misc_feature (371)..(371): n is a, c, g, or t
  modified_base (561)..(561): a, c, t, g, unknown or other
  misc_feature (561)..(561): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctgggtggaggtcgtgggggaggcctggtcaagccgtgggggtccctgagactctcctgcgcacgcctctgattccaccttnagtagtatagcatgaacgtcgggtcccgccaggcctccggaggggaggggctgggagtgggtctcactctattagtagtaatagtcacctanagtactacctaacgcaagacctcgacgtaggaaccggggccctactacccactacttccaccgaagaacgaaccaaaccggaccaaacgaacctacaccgttagtaacttcccgtagggaaacctaaaagtacgaaaccgacggtcccgtaggaacggaaccggcccggaaacgggaccgtaacccggtnttaaggttagtttacgttaacggttggtaggacggttaaggaggttacgtaacttattaacgtccggtaccggaaaccccgttgttccgttttaacgg

SEQ ID NO: 344456 - DNA, 562 bp, Homo sapiens
  misc_feature: GZ8MTXP01BGDUF.11.27.C05.1.454.CMB.2.raw
  modified_base (521)..(521): a, c, t, g, unknown or other
  misc_feature (521)..(521): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaagggggctggagtgggtctcatccattagtagtaatagtcgcctacagatactaacgcaagactcacgtaggaacgggcccgactccacctactcctaccagacgaaccaacgaccaagaactcactgtactctaggactaaagtacaacacgcctagagacggaccgaggaccacgggtctgttgttacttacgttgtaggcgagnggagtctagttctactaccgggaccctaagttcgtttaacg

SEQ ID NO: 344457 - DNA, 473 bp, Homo sapiens
  misc_feature: GZ8MTXP01EFYX8.11.27.C05.1.454.CMB.2.raw
  modified_base (404)..(408): a, c, t, g, unknown or other
  misc_feature (404)..(408): n is a, c, g, or t
  modified_base (410)..(410): a, c, t, g, unknown or other
  misc_feature (410)..(410): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtacagtgtgaggtgcagctggtggagtcgtgggggagcctggtcaagccgtgggggtccctgagactctcctgcgcagcctctgattccaccttcagtagtatagcatgaactggtccgccaggctccgagggagggctggagtggtctcatctagttagtagtaatagtcgacctacagatactaacgcaagactcacgtacgggacgacgacacacactacnnnnncnacacacaacacacacacactcttcgttcactaacaacaacaacacgacgtaacgaacggaacg

SEQ ID NO: 344458 - DNA, 544 bp, Homo sapiens
  misc_feature: GZ8MTXP01A4NJP.11.27.C05.1.454.CMB.2.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtggggggtccctgagactctcctgcgcagcctctggattccaccttcagtagtatagcatgaactgggtccncaggctcgagggagggctggagtgggtctcatccattagtagtaatgtcgacctanagatactaacgcaagactcactgaacgggccactcaccatctccagagacaacgccaaagactcactgtactctaggacaaatgaacagccgtagacgacgccgaaggaccgtaccggntgtagttattacgngtcgagagngggatcttattaactcgtacggaacccctaagttcggtttaacg

SEQ ID NO: 344459 - DNA, 563 bp, Homo sapiens
  misc_feature: GZ8MTXP01DHK5Q.11.27.C05.1.454.CMB.2.raw
  modified_base (449)..(449): a, c, t, g, unknown or other
  misc_feature (449)..(449): n is a, c, g, or t
  modified_base (475)..(475): a, c, t, g, unknown or other
  misc_feature (475)..(475): n is a, c, g, or t
  modified_base (502)..(502): a, c, t, g, unknown or other
  misc_feature (502)..(502): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggaggcctggtcaagccgtgggggtccctgagactctcctgcgcagcctctggattcaccttcagtagtatagcatgaacgtcgggtcccgcacggctccggaggggaaggggcgtgggagtgggtctcatcctattaagtaataatagtcgacctacagaatactaaacgcaacgactcaacgtaggaacgggcccactccaccatcaccaagacaacaacgaccaaagaacctnactgtatctagaacaaatacgaaacncgcctagagaacgccgaaggaccgcgntggttaacttagttacttgtacgngagngattaatatgtaccgaccgactgttgtttaacg

SEQ ID NO: 344460 - DNA, 591 bp, Homo sapiens
  misc_feature: GZ8MTXP01DUCVD.11.27.C05.1.454.CMB.2.raw
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcagccgtgggggtccctgagactctcctgcgcagcctctgattccaccttcaagtagtatagcatagaacgtcgggtcccgccgaggccgtaccggaggggaagggggcgtagggtaggtcgggtctacgatcctatttattagtaatgtcncctaanagtatactaacgcaagactcactaggaacggccgactcacntccacagacacaacgacaaagacctcactagtactctaggaactaaagtgaaaccagtccagacgacgccggagaccgaggtctaagttcgttagttacgttggtaggacgttaaggagggttacttcttaaagtttcgtacccgaccggttaacccgtgttaacgttttcg

SEQ ID NO: 344461 - DNA, 1030 bp, Homo sapiens
  misc_feature: GZ8MTXP01A6706.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagccgtggtcaagccgtgggggtccctgagactctcctgcgcagcctctgacttcaccttcagttagtatagcatagaacgtcgggtcccgccgaggcctaccggaggggaaggggtcgtagggaggtcgggtctactactacctaagtttaggtaagttaaatacggtccgacccttaacgaggtaacttaacccgtaaaccggacgtaacggtaacccttaacccgtaaacccggttaacggggaaaccccggggggtaccccctaaacccgttaccccgtaaaccccgtaaaccttttaccccgtaaaccccgaaacgggaaaaccccgggtaaaaccccggtaaaaaacccccggggtaaacccccaaaaaaacgggttaaaaccccccgtttaaacccgttaaaacccgtttaaccggggtttaaaaccttttaccccggtttaaaccgggggaaaaccgttaaaaaaaccgtttaaaccggtaaaaaaccccggtaaaccgggtaacccccggttaaagggggaaaccgggtaaaaccccgggggaaccccggggtaaaaccgggggaaaccccgggttaaacccggggttaacccgttttaaggggtttaaaccgggtttttaaaccggtttttaacccgggttaggggtttaacgggggtaacccggggaaaacggggttaaaggggggttaaacctttaaaccggtttaaaccgtttttaaaccgggtttaacccccggggttaaacccggggttaaaaccccccccggttaaggtttttaacccgggttttttttaaacccgggg

SEQ ID NO: 344462 - DNA, 594 bp, Homo sapiens
  misc_feature: GZ8MTXP01AW62Q.11.27.C05.1.454.CMB.2.raw
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (548)..(548): a, c, t, g, unknown or other
  misc_feature (548)..(548): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctggagactctcctgcgcagcctctggattccaccttcagttagtatagcatgaactgggtccncgagctccgaggggaaggggctggagtgggtctcactccattagtaagtaaatagcgacctanagatactaacgcaagactcacgtaggaacggggccactccacctactacctccgaagaacaaccgaaccggacccaaacgaacctacacgtgtaactcgtacggacaaagtacgaaaccacgccgaggacgaacgccggtaaggaccgacggtctgtacgttagtacgttgtaggcgaaggnggaggtaaccttataacgttcgaccggaccccgtgttcgtttaacg

SEQ ID NO: 344463 - DNA, 669 bp, Homo sapiens
  misc_feature: GZ8MTXP01BOCWB.11.27.C05.1.454.CMB.2.raw
  modified_base (262)..(262): a, c, t, g, unknown or other
  misc_feature (262)..(262): n is a, c, g, or t
  modified_base (383)..(383): a, c, t, g, unknown or other
  misc_feature (383)..(383): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgagactctcctgcgcagcctntggattccaccttcaagttagtatagctagtacgaacgtcgggtcccgccgaggcctccgaggggaacgggggctgggaggttgggtctcgatccgtattagtaagtaatagtcgacctanagtactacaacgcaacgactacgacgtacgggaacggggcccacgtccaaccctagtcctaccgaagacgaacctaaaccgaccaaagtaacctcgaaactgtaacttcgtagggaaacctaaaagtacgaaaccacggtacccgtaggaaacggaacggacccgggaacgggaccgaaccgggtcttaaggttaagttactttacggttggtacggacggaagggttgggactcgttaacttaacgtaccggtaccggttaaaccccttaagttgttttaaccgg

SEQ ID NO: 344464 - DNA, 537 bp, Homo sapiens
  misc_feature: GZ8MTXP01EPDH2.11.27.C05.1.454.CMB.2.raw
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgaggggaaggggctggagtgggtctcgatccattagtagtaatagtcgcctacagatactaacgcaagactcactgaacgggccactcaccatctccagagacaacgcaaagactcactgtatctaggacaaatcgaaacagcctagacgacgccgaggacacggctgtgttattacgngtgcgagnggttancttattaactcgtacggaacccctgttcgttaacg

SEQ ID NO: 344465 - DNA, 736 bp, Homo sapiens
  misc_feature: GZ8MTXP01B8NIZ.11.27.C05.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (458)..(458): a, c, t, g, unknown or other
  misc_feature (458)..(458): n is a, c, g, or t
  modified_base (637)..(637): a, c, t, g, unknown or other
  misc_feature (637)..(637): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggcgtccgcgttgggttttcctttgttgcttattttagtaaggtgtccagtgtgaggtgcagcgtggtggaggtcgtgggggaggccgtggtcgaacggtccgtcgggggtccctgacgactctcctgcgcagcctctgattcaccttcagtatanagcatgaacgtcggtccgccnggcgtccgaggggaaggggcgtggaggtcgggtctccgattccgtatttagtaagttaagttacgtcgtacctaacagtaactactaaacgcaagtacctacacgtaggaaccgggcccgtacacccacatacctcgaacganaaccgaaacccgtccaaaacgtaacctcaaccgttagtaatacccgttagggaaactaaaagttacggaaacctaacggccccgttaggaaaccgggaacggaaccccgggtaaacggggtttaaccgaacccgggtttcgggtaacgttttggggtttaaacccttttaaaccggggnggggttaccggtaacgggttaacggggttacgttacggtttaacttaacgtttaaccgtacccgggtacccggttaacccgtttgtttcgggtttaacc

SEQ ID NO: 344466 - DNA, 527 bp, Homo sapiens
  misc_feature: GZ8MTXP01C4249.11.27.C05.1.454.CMB.2.raw
  modified_base (363)..(363): a, c, t, g, unknown or other
  misc_feature (363)..(363): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaacgtgggtccgccaggctccgaggggaaggggctgggagtgggtctcatccattagtagtaatagtcgcctanagatacctaacgcaagactcactagaacgggcactcacatctcagagacaacgaccaagaactcactgtatctggacaaatagaacagcctgagacgcgaggacacgcgtgtgttatacttgtgcgaggngagctatntctacggaccctaagttcgtttaacg

SEQ ID NO: 344467 - DNA, 728 bp, Homo sapiens
  misc_feature: GZ8MTXP01BWUIH.11.27.C05.1.454.CMB.2.raw
  modified_base (305)..(305): a, c, t, g, unknown or other
  misc_feature (305)..(305): n is a, c, g, or t
tcagcgagagataccacgaccggtgctcgatttagacgcgatcgaagggtttggggagagaggagccttagccctggattccaaggcctatccacttggtgatcagcactgagcaccgaggattcaccatggaactggggctccgcttgggttttcctcgttgctcttttaagaggtgtccagtgtcaggtgcaatggaggagtcgtgggggaggcgtggtccagccgtgggaggtccctgagactctcctgtacagcctctggcttcaccttcattaccctatggcatgccacgtcgggtcccnccagacctccgaggcgagggggctgggagtggggtgctaggttatttcatatgaatggaaatgtgtacttctaattcagtaacccgttcccggtaggaaacgggggtccccaaatttcccgtaccccgttaccgtacccgtaaacggtaaccggaaacctaaaacgtttccccgaaacgggtacccaaaccgtacccggaccgtagttaaacgttccctttaggggaaccaaaaagttacgaaaaccgacgtaccccgtaggaaggaaaccgtcgttaacgggaacggggaacccgaacgggggtcctttaggttacggtttaaatttaccgttaggttaggttaaccgttaaaaggttacttttaagttaagtaagggttacgggtaggttaccgggttaaccgggggttaaccgttttcgg

SEQ ID NO: 344468 - DNA, 570 bp, Homo sapiens
  misc_feature: GZ8MTXP01ARE0A.11.27.C05.1.454.CMB.2.raw
  modified_base (366)..(366): a, c, t, g, unknown or other
  misc_feature (366)..(366): n is a, c, g, or t
  modified_base (440)..(440): a, c, t, g, unknown or other
  misc_feature (440)..(440): n is a, c, g, or t
  modified_base (522)..(522): a, c, t, g, unknown or other
  misc_feature (522)..(522): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggaggcctggtcaaggccgtgggggtccctgagactctcctgcgcagcctctggattccaccttcagtagtatagcatgaactgggtccgccaggctccgaggggaaggggctgggagtgggtctcatccatttagtagtaatagtcgcctanagatactaacgcaagactcactggaacgggcccgaactccaccatcctaccagacgaacaacgaccaaagaacncactgtatcaggacaaagtgaaactagcctggacgacgccgaagggaccacggcctgtgttattaccgttggtgtacggagngggactcgtaattcgtcgtacggttaaccccgtaagttcgtttaaccg

SEQ ID NO: 344469 - DNA, 693 bp, Homo sapiens
  misc_feature: GZ8MTXP01CFN4X.11.27.C05.1.454.CMB.2.raw
  modified_base (612)..(612): a, c, t, g, unknown or other
  misc_feature (612)..(612): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatcgaacgtcgggtcccgccgaggccgtccggaagggggaagggggcgtgggtaggtggggtctcgacttccgtaagtttacgtaaagtaagttaggtaccgtacccttaacgaaggtaacttaaccgtaaaccgcaacggaaccctcaaaccgtaggaaaccggggcccgaactcccaaccctagtccctacgaacggaacgaacccaaaccggtaccaaagaaccctcaacctgtaacttcctaggggactaaaagttgaaaccaggccctagaacggacggacccggtaaggaaccgaccggtgtcgttagttacgtttaacgngggtcggacgaaggaggggaactctttaaagttaacgttcccggtacggaaacccccgttaagttcccggtttttaaccgg

SEQ ID NO: 344470 - DNA, 535 bp, Homo sapiens
  misc_feature: GZ8MTXP01AM595.11.27.C05.1.454.CMB.2.raw
  modified_base (373)..(373): a, c, t, g, unknown or other
  misc_feature (373)..(373): n is a, c, g, or t
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggccgtggtcaagccgtggggggtccctgagactctcctgcgcagcctctggattcaccttcagtagtatagcatgaactggtccgcagctccgagggaaggggctggagtgggtctcatccattagtagtaatgtcgcctacagtatacctaacgcngactcactgaacgggccactcacatctaccagacacaacgccaaagaacctcatgtatctggacaaangaacagccngagacgcaggacacgggctgtgttattacnggtacgnggagagggacncttagtaactcgtacggaacccctgttcggtttaacg

SEQ ID NO: 344471 - DNA, 748 bp, Homo sapiens
  misc_feature: GZ8MTXP01CZYJE.11.27.C05.1.454.CMB.2.raw
  modified_base (683)..(683): a, c, t, g, unknown or other
  misc_feature (683)..(683): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggtttccttgttgctatttagaaggtgtccagtgtgaggtgcagcgtggtggagtcgtgggggaggccgtggtcaaggccgtgggggtccctgagactctcctgcgcagcctcgtggacttccaccctttcgaagttagttaatagctatagaacgtcgggtcccgccgtacggcctaccggaagggggtaacgggggccgttaggggacggttcgggggtcctaccgtaacgtcccgttaaagtttaagggttaaagttaaagttacggtacccgtacccttaaacgaaggtaaactaaccgttaaaccgaacaacggtaaacctccgtaaacccgttacggggaaaccggggtccccgtaaaccttacccgaaaccctacttaccccgaccaaagaccgtaaacccgaaaaccgtacccaaagtaacctcaaccttggtaacttccgaagggtaaaccaaagttacgaaacgacgtacccgagaacggacggaccgtaaagggaccacgggtcttaaggtacgttagttacgnggtcgacggaggacggagttcttaaagttcgtcccgtacggttaaccccgttaattccggttttg

SEQ ID NO: 344472 - DNA, 607 bp, Homo sapiens
  misc_feature: GZ8MTXP01BZJWF.11.27.C05.1.454.CMB.2.raw
  modified_base (281)..(281): a, c, t, g, unknown or other
  misc_feature (281)..(281): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtanagcatgaacgtgggtcccgccaggcctccgaggggaaggggcgtggagtgggtctcatccattagtagtaatgtcgacctacgagtactactaacgacaacgactcactaggaacgggccgactacacctactcctacagacgacaaccgaccaagactcactgtatcctagacaaatagaacgagcccgtgacgacgaccggacggaccgacgggtctaaggttagttacgttaacgttggtcggtacggaaggttagggacgtaaccttaagtttaaccgttcggtaacccggttaacccccgtaagttttccgttttaaccgg

SEQ ID NO: 344473 - DNA, 633 bp, Homo sapiens
  misc_feature: GZ8MTXP01A5JAS.11.27.C05.1.454.CMB.2.raw
  modified_base (360)..(360): a, c, t, g, unknown or other
  misc_feature (360)..(360): n is a, c, g, or t
  modified_base (472)..(472): a, c, t, g, unknown or other
  misc_feature (472)..(472): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgaggggagggctggagtgggtctcatccattagtagtaatagtcgacctanagatactaacgcaagactcatcggacggggccactaccaccacttccaccagacgacaaccggaccaaagaacctcaacctgtaacttcacggactaaaagtcgaaaacccncggccgtaggacggaccgggaccggtaacgggaaccgtacgggtcttaagggttacgttacgtttacgttagggtacgggacgggagggttacggttacgttaactttaacgttaaccgtacccgggttaaccccgggaaccccgttgtttcggtttaacg

SEQ ID NO: 344474 - DNA, 526 bp, Homo sapiens
  misc_feature: GZ8MTXP01APWO4.11.27.C05.1.454.CMB.2.raw
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
tcagcgagagataccacgaccggtgctcgatttagacgcgatcgaagggtttgggggagagaggagccttagccccggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgcgcagcctctggattcaccttcagtagttatagcatgaactgggtccgccaggctccaggggaaggggctggagtgggtctcatccattagtagtaatagtgcccctacagatactacgcagctcactgaacgggccgactcaccatctccagagacaacgccaaagaactcactgtatctgacaaatgaacagcctgagagccgagacacggtctgtntattacgngttgcgagaggngctaatatcgtcggaaccccgatcgttcgttttaag

SEQ ID NO: 344475 - DNA, 679 bp, Homo sapiens
  misc_feature: GZ8MTXP01DA6U5.11.27.C05.1.454.CMB.2.raw
  modified_base (397)..(397): a, c, t, g, unknown or other
  misc_feature (397)..(397): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgacgactctcctgcgcacgcctcgtgtcttcaccttcattaccatcggcatgcacgtcgggtcccaccagtacctccgagggcggagggggctgggaggtggggtggcgttagtttatttcgattagtgaagtaggaaattagtagtaaacctttntaacgttacgtaacgtaaccgttccggtagggaaacgggggtccctaacgttccctacccgttcctaccgaaggacgaaacctaaacgttcccgaaggccaaccgaccgcgttacgtacgtcggtaacgtacctaaagtaccgaaacgtaaccgcccgttagaacggtacgcgtacggaacgggtaaccgtcggtcgttagttacgttagttacgtgttagacgttaaagttaacttacgtaagtagggtacggttacgggtaacggttcgggggttaaccg

SEQ ID NO: 344476 - DNA, 605 bp, Homo sapiens
  misc_feature: GZ8MTXP01BJ5WJ.11.27.C05.1.454.CMB.2.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattccaccttcagtagtatagcatagaacgtcgggtcccgccgaggcctccgaggggaaggggcgtgggagtgggtctcatcctattagtagtaatgtcncctanagatactaacgacaagactcacgtacggaacgggccgactccaccatccacagacaacaaccgacaaagactacactagtactctaggaacaaatacgaaactacgccgtaggacgacggccggaaggaccgacggtctaaggttagttaacgttacgttggtacggacggagggaggttactaagttacttaacgtacccggtaccggttaaccccgtaagtttcggttttaaccg

SEQ ID NO: 344477 - DNA, 566 bp, Homo sapiens
  misc_feature: GZ8MTXP01AJCIY.11.27.C05.1.454.CMB.2.raw
  modified_base (446)..(446): a, c, t, g, unknown or other
  misc_feature (446)..(446): n is a, c, g, or t
  modified_base (509)..(509): a, c, t, g, unknown or other
  misc_feature (509)..(509): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagttagtatagcatgaacgtggtccgcaggctcgagggaggggctggagtgggtctcatccattagtagtaatagtcgacctagagactactaacgcaagactcactggaacgggccactccaccatcctaccagacgaccaaccggaccaaagaacctcactgtactacncggaacaaagtcgaaacagccctggaacggacggccggaaggaccacggctgtgttattacgnggtcggacggaggaggttacgtccttattctccgtacgggaacccctgttcgtttcg

SEQ ID NO: 344478 - DNA, 648 bp, Homo sapiens
  misc_feature: GZ8MTXP01EFBVZ.11.27.C05.1.454.CMB.2.raw
  modified_base (557)..(557): a, c, t, g, unknown or other
  misc_feature (557)..(557): n is a, c, g, or t
  modified_base (598)..(598): a, c, t, g, unknown or other
  misc_feature (598)..(598): n is a, c, g, or t
  modified_base (605)..(605): a, c, t, g, unknown or other
  misc_feature (605)..(605): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagcgtggtggagtcgtggggagcctggtcagccgtgggggtccctgagactctctgcgcagcctctgattccaccttcagttatatagcatagaacgtcgggtcccgccgaggcctaccggaggggaagggggctagggaggttcgggtctacgataccgtaagtttaagtagtaatgtccgaccttagagtactacgtaaccgacaagtacctacgacgtaggaaaccgggcccgtactaccaaccctatcccaccgaagaacgaacctaaaccgacaaagactacattgtatcctaggaaacctaaagtaccggaaactcggtcccagggacgaaacgcccgggaaggacctaaccgggtntttaagggtattaaacttcggttagagggacgttaaagggngttactntttaaacgtgttaccgaccggttaacctgtttccgttttaacg

SEQ ID NO: 344479 - DNA, 648 bp, Homo sapiens
  misc_feature: GZ8MTXP01D7RS1.11.27.C05.1.454.CMB.2.raw
  modified_base (375)..(375): a, c, t, g, unknown or other
  misc_feature (375)..(375): n is a, c, g, or t
  modified_base (499)..(499): a, c, t, g, unknown or other
  misc_feature (499)..(499): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggttttccttgttgctatttagaaggtgtccagtgtgaggtgcagctggtggagtcgtgggggagcctggtcaagccgtgggggtccctgagactctcctgcgcagcctctggattccaccttcagttagtatagcatagaacgtgggtcccgccgaggcctaccggaggggaaggggcgtgggaggtcgggtctcgtatccgtatttagtagtaatagtcgacctanagatactaacgcaagactcacgtggaacgggccgactccaaccattccacccaagaacgaaccgaaaccgacccgaaagtaaccctacaccttagtacttcgtaggaactaaaagtacgaaacncgtacccgtaggaacgaacggccggtaagggaaccgaccgggtcttaaggttagttaacgttaccgttggtacggacggttaagggagggttacgtaactttaagttaacgttccgaaccgggttaccccttaagttcggtttttaacg

SEQ ID NO: 344480 - DNA, 673 bp, Homo sapiens
  misc_feature: GZ8MTXP01BI93X.11.27.C05.1.454.CMB.2.raw
  modified_base (366)..(366): a, c, t, g, unknown or other
  misc_feature (366)..(366): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcaccttcagtagtatagcatgaacgtcgggtcccgccgaggcctccgaggggaaggggcgtgggagtgggtctcatccattagtagtaatagtcgcctanagactactaacgcaagactcacgtcggaacgggccgaactccaacctatccctacgagaacgaacaaaccgaccctaaagaacctcaacgtagtactaccgtagggaacctaaaagtcggaaaaccacggtacccgagggaacggaaccggacccgggaaagggaacccgaacccgggttcgttaagggtttgttaaacgtttaaccgttggggttaccggaacgggaagggttagggttaacgtaactttaacttaacggttccgtaacccgggggttaaaccccttggtttcgtttttaaccggg

SEQ ID NO: 344481 - DNA, 616 bp, Homo sapiens
  misc_feature: GZ8MTXP01CVFIF.11.27.C05.1.454.CMB.2.raw
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtcgggtcccgcgaggcctccgaggggaagggggctgggagtgggtctcatccattagtagtaatagtcgcctanagatacctaacgcngactcacgtaggaacgggcccgactccacccatcctaccagacgaccaacgccaaagacctcactgtatcgtaggacaaatcgaaacagcctagacgacggccggaaggaccgacgggtcttaaggttgttaagtttaaccgttgggtacggtacggttaaggacggggttacgtcctttaaagtttcgttaccggtaccggggttaaacccccttaagttccggtttttaaccgg

SEQ ID NO: 344482 - DNA, 643 bp, Homo sapiens
  misc_feature: GZ8MTXP01DLZOL.11.27.C05.1.454.CMB.2.raw
  modified_base (362)..(362): a, c, t, g, unknown or other
  misc_feature (362)..(362): n is a, c, g, or t
  modified_base (582)..(582): a, c, t, g, unknown or other
  misc_feature (582)..(582): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctggtcaagccgtgggggtccctgagactctcctgcgcagcctctggattcaccttcagttagtatagcatgaacgtgggtccgcaggctccgaggggagggctggagtgggtctcatccattagtaagtaatagtcgacctanagtatactaacgcaagactcacgtaggaacgggccgactacacctattccaccaagacgaaaccaaacgtaccaaagaacctcaaactgttaatcctaggggaacctaaaagtacgaaacacggtacccgtaggaacgaaccgggcccgtaaaggggacccgtaacggggtcttaagggttacgttaacgtttaacgttgggttacggcgttaaaggggngggttacttcttaatttaacgtcccgtaccgggttaaacccccgtgtttcggtttttccgg

SEQ ID NO: 344483 - DNA, 658 bp, Homo sapiens
  misc_feature: GZ8MTXP01D4SMD.11.27.C05.1.454.CMB.2.raw
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattccaccttnagtagtanagcatgaacgtgggtcccgccaggcctaccggaggggaagggggctagggagtgggtctcaactcctaagtttagtaagtaaattagtccgaccttaacagtaactacctaaaccgacaacgactaccaacgtcggaaacgggcccgaactcccaaccatcctaccgaagaacgaaaccaaaccgaccaaagtaacctcaacttgtaatctacgggaaacaaagtacgaaacacgaccgtaggaacgaaccggccggaaacggaccgaccgggtcttaaggtagttacttaccgttggtacggacgggaaggttagggttacgtaacttaacgttccgttaccgtaccggggaaaccccttgttcccgttttaagg

SEQ ID NO: 344484 - DNA, 542 bp, Homo sapiens
  misc_feature: GZ8MTXP01CIL0N.11.27.C05.1.454.CMB.2.raw
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagcgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctggagactctcctgcgcagcctctggattcaccttcagtagtatagcatgaactgggtccgccaggctccgaggggaagggggctggagtgggtctcatccattagtaagtaatagtcgcctacagtactactaacgacaagactcaatgaaggggccactcaccatctccagacgaacaacgaccaagaactcaactgtatcctaggacaaatgaaacagcctagagacgccgaggacacggctgtnttatacttgtgngagnggagtctataatctacggacccctaagttcggtttcg

SEQ ID NO: 344485 - DNA, 612 bp, Homo sapiens
  misc_feature: GZ8MTXP01DV150.11.27.C05.1.454.CMB.2.raw
  modified_base (361)..(361): a, c, t, g, unknown or other
  misc_feature (361)..(361): n is a, c, g, or t
  modified_base (443)..(443): a, c, t, g, unknown or other
  misc_feature (443)..(443): n is a, c, g, or t
  modified_base (517)..(517): a, c, t, g, unknown or other
  misc_feature (517)..(517): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattccaccttcagtagtatagcatgaacgtgggtccgccaggctccgagggaaggggctggagtgggtctcgatccattagtagtaatagtcgcctanagatactaacgcaagactcactggaaacgggcccgactccaacctatcctaccgaagacgaaccaaacggaccaaagtaacncaactgtaactcctaggaacaaaatcgaaacagtcccgaggaacgaacgcccggtaagggaaccctaccggggnttaaggttgttaactttacgttgggtacggacgaagggacggaagtctttaagttaacgtccggtaaccggaaccccgtaagtttcgttttaacg

SEQ ID NO: 344486 - DNA, 564 bp, Homo sapiens
  misc_feature: GZ8MTXP01AOC0J.11.27.C05.1.454.CMB.2.raw
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtcccgccaggcctccgaggggaaggggctggagtgggtctcatccattagtagtaatgtcncctanagactactaacgcaagactcactaggaacgggccactccaccatcctacagacgacaaaccgaccaaagaacncactgtatctagggacaaagtagaaaccacgcctagagacgccggaggacgacggtctgtgttattacgttgtaggcgaggaggataacttattaacgtcgtaccggaaccccgtaagttcgtttaacg

SEQ ID NO: 344487 - DNA, 549 bp, Homo sapiens
  misc_feature: GZ8MTXP01AQ3HZ.11.27.C05.1.454.CMB.2.raw
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (419)..(419): a, c, t, g, unknown or other
  misc_feature (419)..(419): n is a, c, g, or t
  modified_base (470)..(470): a, c, t, g, unknown or other
  misc_feature (470)..(470): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaggggctggagtgggtctcatccattagtagtaatagtcgcctanagatactaacgcngactcacgtgagggccgactcacatctcagagacaacgaccaagaacncgactagtactctaggacaaatgaaacgacgcctagagacggccgaggacncggctgtcgttataccgttgtggcgttagacgggagtaactagttaactcgtacgggaacccctaagttcgtttaaccg

SEQ ID NO: 344488 - DNA, 578 bp, Homo sapiens
  misc_feature: GZ8MTXP01AKEET.11.27.C05.1.454.CMB.2.raw
  modified_base (286)..(286): a, c, t, g, unknown or other
  misc_feature (286)..(286): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (507)..(507): a, c, t, g, unknown or other
  misc_feature (507)..(507): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggagcctggtcaagccgtgggggtccctgagactctcctgcgcacgcctctggacttccaccttcagttagtanagcatgaacgtcgggtccgccgaggcctccgaggggaggggcgtgggagtgggtctcatccatttagtagtaatagtcgacctanagatactaacacngactacacgtacggaacggccgactcacccatccacgagacgaaccaacgaccaaagtacnctatntatcaggaacaatcgaacngcctgagacggcgagacgacggnttgtgttattaccgnggtcgaacggaggacgttacgtaacttagtttaacgtccggtaccggttaaccccgtgttccgttttaacg

SEQ ID NO: 344489 - DNA, 614 bp, Homo sapiens
  misc_feature: GZ8MTXP01A1X4M.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggacttcaccttcagtagtatagcatagaactgggtcccgcgaggcctccgaggggaaggggctaggagtgggtctcatcctattagtagtaatagtcgcctaacgagactactaacgccaagacctaccaagtacggaacggggccccgtaactccaaccgtatccctaccgaggaacaaccaaaccgacccaaagaaccttcactatactaccgtagaacaaagtacgaacacgccgtagacgacgaccgtaaggaccgcgtcgttgtacgttacgtacgttggtaggacggaggaggacgttaacttaacgttccgtaccggtacccggttaacccgttgttcggtttcg

SEQ ID NO: 344490 - DNA, 565 bp, Homo sapiens
  misc_feature: GZ8MTXP01C14TL.11.27.C05.1.454.CMB.2.raw
  modified_base (338)..(338): a, c, t, g, unknown or other
  misc_feature (338)..(338): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagtagtatagcatgaacgtggtccgcaggcctccgagggaaggggctgggagtgggtctcancctattagtagtaatagtcgcctacagtatactaacgacngactcaactggaacggggccactcaccatccncagacacaacgaccaagactcactgtatccgtaagaacaaagacgaacgacgacgaggaacgacggacgaacggtacgcggtntgtagttacgttgngtagacggaggnggttacgtaatagttaacgtaccggtaccggttaccgtgttcgttg

SEQ ID NO: 344491 - DNA, 564 bp, Homo sapiens
  misc_feature: GZ8MTXP01DCMER.11.27.C05.1.454.CMB.2.raw
  modified_base (371)..(371): a, c, t, g, unknown or other
  misc_feature (371)..(371): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
  modified_base (522)..(522): a, c, t, g, unknown or other
  misc_feature (522)..(522): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaactgggtcccgcaggctccgagggaggggctggagtgggtctcatctattagtagtaatagtcgcctacagatactaacgcngactcacgtgaaacgggccactcaccatcaccagacgaacaacgaccaaagaacctcactgtaactcctagggaacaaagtcgaaacacgccctaggaagaacgccgaagggacaccgggtntaagtgttacttcgngtacggacgaaggnggataacttaattcgtccgtaccggttaaccctgttcgttcg

SEQ ID NO: 344492 - DNA, 549 bp, Homo sapiens
  misc_feature: GZ8MTXP01C3BU2.11.27.C05.1.454.CMB.2.raw
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagtagtanagcatgaactgggtccncaggctccgagggaggggctggagtgggtctcatccatttagtagtaatagtcgcctacagatactaacgcngactcactgaagggccgactcacatcnccaganacaacgcaagaactcactgtatctggacaaagtcgaaactgaccctgaacgacgccggaaggaccacgggctggtattattacgttgtacggcggttaagcggagtcttaattcgtactcgggaacccctaagttcgttttaacg

SEQ ID NO: 344493 - DNA, 737 bp, Homo sapiens
  misc_feature: GZ8MTXP01CYWHD.11.27.C05.1.454.CMB.2.raw
  modified_base (616)..(616): a, c, t, g, unknown or other
  misc_feature (616)..(616): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagcgtggtggagtcgtgggggagccgtggtcaaggccggtgggggtccctgacgactctcctgccgcacgcctctaggtacttcctaccttactagttagtatagctagtacgtaacgtcgggtcccgcgacggccgtaccggagggggaacggggtcgtagggtacgggtcgggtctacgtaacgtaccgttaagtttaaggttaaagttaaagttacgtacccgaccttaaacgagtaaccttaaccgtaaccggactaacggtaacctaccgtaaacggtacgggaaaccggggtaccctaacctacccaaccctacttacccaaccgaagggaaacctaaacccggaaaccgtaaccgaaaacgtacctacctaagttgtaactccgtaggaaactaaacgtacgaaaccgcgtacgngaacggaccggtacgaacggaccgcggtgtaaggttacttagttcgttggaccggagaagggcggttaacttgttaaacgttccgtaacggtacccgggttaaccctgtttccggtttaag

SEQ ID NO: 344494 - DNA, 702 bp, Homo sapiens
  misc_feature: GZ8MTXP01EFDHR.11.27.C05.1.454.CMB.2.raw
  modified_base (254)..(254): a, c, t, g, unknown or other
  misc_feature (254)..(254): n is a, c, g, or t
  modified_base (391)..(391): a, c, t, g, unknown or other
  misc_feature (391)..(391): n is a, c, g, or t
  modified_base (459)..(459): a, c, t, g, unknown or other
  misc_feature (459)..(459): n is a, c, g, or t
  modified_base (611)..(611): a, c, t, g, unknown or other
  misc_feature (611)..(611): n is a, c, g, or t
  modified_base (636)..(636): a, c, t, g, unknown or other
  misc_feature (636)..(636): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagctggtggagtcgtgggggagcctggtcaagccgtgggggtccctgagactctcctgcncacgccctgactctaccttctagtagttatagcatagaacgtacgggtccggtccgacggccgtccgaggggaacgggtcggtggaggtcgggtcgtcctacgtcctagttagttaagtaagtagtcgaccctacanatactacgaacacgtctacacgtacggaacgggaccgacctaccgaaccctatccgtaacaacggaanaaacccaaaccgtaccaaacgtaaacttccccaacgtttgttaaattttcgaaacccgtaaaagtacgtaaaccgaaacgtcccggtagaaccgggacgaccggttaaaccggacgtaccggtacttggtttataaacgtttcgttgggganaccgggtaaagggaagttacggttntttaacgtttaacacggggttaacccgtaacccccgtgtttacgtttcgtttttaacggtttccgg

SEQ ID NO: 344495 - DNA, 578 bp, Homo sapiens
  misc_feature: GZ8MTXP01C6A65.11.27.C05.1.454.CMB.2.raw
  modified_base (529)..(529): a, c, t, g, unknown or other
  misc_feature (529)..(529): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtcccgccaggctccgaggggaaggggctggagtgggtctcatccattagtagtaatagtcgcctacagatactaaccgcaagactcgactaggaacggggccgactccaccctatcctaccagaacgaaccaaacggccaaagaacctcacctgtatctaggacaaatacgaaacacgccctagacgacgccgaggacacgggcctggtagttattacgttgtcgcggaaggnggttacgtcttagttaactcgtaccgggaacccctaagttcgtttaacg

SEQ ID NO: 344496 - DNA, 731 bp, Homo sapiens
  misc_feature: GZ8MTXP01BW103.11.27.C05.1.454.CMB.2.raw
  modified_base (687)..(687): a, c, t, g, unknown or other
  misc_feature (687)..(687): n is a, c, g, or t
  modified_base (698)..(698): a, c, t, g, unknown or other
  misc_feature (698)..(698): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaacgtgggcctccgcttgggttttccttgttgcttattttagaaggtgtccattgtgaggtgcagcgtggtggagtcggtgggggagccgtggtcaaggccggtcgggggtccctggacgtactctcctgcgcacgcctcgtggtacttccaccttcagttagtatagcagtagaacgtcggtccgccgaggccgtaccggagggggaacggggcgtgggtaggttcgggtactacgtactaccgtaaagtttaacggttaaagtaaacgttacggtacccgtacccgttaaacgaaaggtaaacctaacccgttaaaccgaccctaacggtaaccctacccgtaaacggttaacgggaaacccgggggtcccctaaacctacccaacccgtaacgttccccgaaccgaaaggaaacccgaaacccgaaaaccccgggacctaaaaacgtacccttacaccgttacgtacttaccctaaggggaaacctaaagtaccgaaacgtacgccgtagaggaccgacggaacggtacgacggtctaagtgttactacgngtagacggagngttatcttatcgcgtacggacctgtttcgttcg

SEQ ID NO: 344497 - DNA, 550 bp, Homo sapiens
  misc_feature: GZ8MTXP01BGO25.11.27.C05.1.454.CMB.2.raw
  modified_base (427)..(427): a, c, t, g, unknown or other
  misc_feature (427)..(427): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
  modified_base (538)..(538): a, c, t, g, unknown or other
  misc_feature (538)..(538): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtccgcaggctccgaggggaagggctggagtgggtctcatccattagtagtaatagtcgcctacagactactaacgcaagactcactagaacgggccactcaccatcaccagacgacaaacgaccaagaacncactgtaactctaggacaaatcgaaaccagcctagagacgccgaaggacacggntaagtgttattacnggtgcggagnggagtctaagttaactcgacggttaaccccgtnttcgtttaaccg

SEQ ID NO: 344498 - DNA, 606 bp, Homo sapiens
  misc_feature: GZ8MTXP01DG9EA.11.27.C05.1.454.CMB.2.raw
  modified_base (414)..(414): a, c, t, g, unknown or other
  misc_feature (414)..(414): n is a, c, g, or t
  modified_base (518)..(518): a, c, t, g, unknown or other
  misc_feature (518)..(518): n is a, c, g, or t
  modified_base (537)..(537): a, c, t, g, unknown or other
  misc_feature (537)..(537): n is a, c, g, or t
  modified_base (545)..(545): a, c, t, g, unknown or other
  misc_feature (545)..(545): n is a, c, g, or t
  modified_base (551)..(551): a, c, t, g, unknown or other
  misc_feature (551)..(551): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggacttcaccttcagtatatagcatgaacgtcggtccgcgaggcctccgaggggaaggggctgggaggtgggtctcactcctagtttagtaagtaaatagtccgacctaacagtactactaacgcaagactacacgtaggaacgggccgtacncaaccatcctaccgaagacgaaacaacgtaccaagaactcgaactgtaatccagggaacaaatacgaactagcccaggacgacggcccgaaggaccgaccggtnttgttaagttactttacgnggtacggnggaagngggactaacgttaattccgtaccggtaccggaaaccccgttgttcggtttttccg

SEQ ID NO: 344499 - DNA, 556 bp, Homo sapiens
  misc_feature: GZ8MTXP01AN0XR.11.27.C05.1.454.CMB.2.raw
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
  modified_base (505)..(505): a, c, t, g, unknown or other
  misc_feature (505)..(505): n is a, c, g, or t
  modified_base (532)..(532): a, c, t, g, unknown or other
  misc_feature (532)..(532): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttcctgttgctatttagaaggtgtccagtgtgaggtgcagctggtggagtcgtgggggaggcctggtcaagccgtggggggtccctgagactctcctgcgcagcctctggattcaccttcagtagtatagcatgaactgggtcccncaggctccgagggaggggctggagtgggtctcatccattagtagtaatagtcgcctanagatactaacgcaagactcacgtggaacgggccgactccaactatcctaccagacgacaacgtaccaaagacctcgactgtactctggacaaatcgaaacagcctaggacgacggaccgaagggacacgggtctaaggtattattacgnggtcgacgaggcgggatctaattaacncgtacggaaccccgtgttcgttcg

SEQ ID NO: 344500 - DNA, 659 bp, Homo sapiens
  misc_feature: GZ8MTXP01A03TP.11.27.C05.1.454.CMB.2.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (366)..(366): a, c, t, g, unknown or other
  misc_feature (366)..(366): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagcgtggcggagtcgtgggggagcctggtcaagccgtgggggtccctgagactctcctgcgcagcctctggattcaccttcagtagttanagcatgaactgggtccnccgaggctccgaggggaagggctgggagtgggtctcgatccagttagtagtaaatgtcgcccctanagtatactacgacagctcacgtggaacgggtcccgactccgaacctattcctacccgaagacgaaccaacgacccaaagtaacctcgtacttagtaactacgttacgaactaaagttacgaaaccgacgaccgtaggagaacggaccccggaaggtaacccgacgggtccttggttaacggttaactttaaccggtgggttacggacggtaagggaacgggttcgttaaccgttaagtttacgtaacccgtacgggtaaacccccgttgtttaaccggttcgtttttaacggg

SEQ ID NO: 344501 - DNA, 639 bp, Homo sapiens
  misc_feature: GZ8MTXP01AGS6W.11.27.C05.1.454.CMB.2.raw
  modified_base (578)..(578): a, c, t, g, unknown or other
  misc_feature (578)..(578): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtggggaggcctggtcaagccgtgggggtcctgagactctcctgcgcacgcctctgacttcaccttcagtagtatagcatgaacgtcgggtccgccgaggcctaccggaggggaagggggctagggtaggtcgggtctcgactaccgtattaagtagttaaatgtccgtacctaacagtactacgtaacgcaagactcacgtacggacgggccacctacaccctattccaccgaagaacgaacgaaacgaccaaagtaacctacacttacgtactcgtaagggaacaaaagttcgaaacgacgcccgtaaggacggaaccggaccggaaacgggaccgacggtctgggttacttacgttacgttggtaacggngggaagttaggggctaacgttacttaacgtccggtaccgggttaccctgttcggttttaag

SEQ ID NO: 344502 - DNA, 536 bp, Homo sapiens
  misc_feature: GZ8MTXP01ES92R.11.27.C05.1.454.CMB.2.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (473)..(473): a, c, t, g, unknown or other
  misc_feature (473)..(473): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggagcctggtcaagccgtggggtcctgnactctctgcgcgngccgtcaggacttccacttcagtagtatagcatgacgtgggtcccnccaggcctccgaggggtaaggggctaggacgtgggtctcactctattagataatgtcnctanagactacaacgcaacgctacgactgggaacgccgactcacatcncagacacaacgctaanactnactnacttcaggaanaanagacgacgcgagagacgacgacgacgacgngtgtgttagtacgttgtgagaggagacgtaatataacgtcgtacgttaccgtaacgttcgttg

SEQ ID NO: 344503 - DNA, 548 bp, Homo sapiens
  misc_feature: GZ8MTXP01BDTYG.11.27.C05.1.454.CMB.2.raw
  modified_base (359)..(359): a, c, t, g, unknown or other
  misc_feature (359)..(359): n is a, c, g, or t
  modified_base (427)..(427): a, c, t, g, unknown or other
  misc_feature (427)..(427): n is a, c, g, or t
  modified_base (485)..(485): a, c, t, g, unknown or other
  misc_feature (485)..(485): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtatatagcatgaactgggtccgccaggctccgaggggaggggctggagtgggtctcatccattagtagtaatagtcacctanagatactaacgcaagctcactggaacgggccgactcaccatcctaccagacgacaaacgccaaagacncactgtactctaggacaaatcgaaacacgcctagagacgccggtagacgacgtctgtnttaagttcgttgtgcgaggaggagtaactattaacgtcgtacggaacccgtgttcgtttaacg

SEQ ID NO: 344504 - DNA, 613 bp, Homo sapiens
  misc_feature: GZ8MTXP01C0E96.11.27.C05.1.454.CMB.2.raw
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (546)..(546): a, c, t, g, unknown or other
  misc_feature (546)..(546): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaactgggtccgcaggctccgagggaagggggctggagtgggtctcatcctattagtagtaatagtcncctanagatactaacgcaacgactcacgtgaacgggccactccacctatacctccaagacgaaccaaacgcccaaagaacctcacttgtaactcgtagggaactaaagtgaaaccacgccctaggaacgacggaccgaggaccacgggtcttggtgttaacgttaccgttggttacgggcggttaaagggngggttacgtaactttaagtttaacgtacccggtaccgggaacccccgttgttccggtttttaaccgg

SEQ ID NO: 344505 - DNA, 681 bp, Homo sapiens
  misc_feature: GZ8MTXP01AETX4.11.27.C05.1.454.CMB.2.raw
  modified_base (390)..(390): a, c, t, g, unknown or other
  misc_feature (390)..(390): n is a, c, g, or t
  modified_base (530)..(530): a, c, t, g, unknown or other
  misc_feature (530)..(530): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggagcctggtcaagccgtgggggtccctgagactctcctgcgcagcctctggattcaccttcagttagtatagcagtgaacgtcgggtccgccgaggccgtaccggaagggggaacgggggcgtggggaggttggggtctctactaccgtatttaggtaagttaaatagtccgaccctanagtaactacgtaaacgcaacgacctacacgtacgggaacgggcccgactaccaaccctattaccacccaaggaaccgaacccaaaccggtacccaaagtaacctaccacgttgtactcgtaggaactaaagtcgaaaccngcctaggaacgacggaccggtaacgggaccgtacggtcgtaaggtcgtttaaacgttcgttaggtcgggaacgacgggttagggacttaaccgttaagttaacccgttaccgggtacccgggttaaaaccccgttgtttcggttttaaccg

SEQ ID NO: 344506 - DNA, 609 bp, Homo sapiens
  misc_feature: GZ8MTXP01BEKEF.11.27.C05.1.454.CMB.2.raw
  modified_base (374)..(374): a, c, t, g, unknown or other
  misc_feature (374)..(374): n is a, c, g, or t
  modified_base (478)..(478): a, c, t, g, unknown or other
  misc_feature (478)..(478): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattccaccttcagttagtatagcatgaacgtcgggtcccgccgaggcctaccggaggggaaggggctgggagtgggtctcgatcctattagtaagtaatagtcgacctanagtatactaacgcaagactcacgtggaaacgggccgactcaccatccaccagacgacaaccgacaaagactcactgtaatccgtaggaactaaagtcgaaaccncgaccgtagacggacgaccggaacggaccgtacggtgttaagttagttacgttacgttggtacggacggaggacggttacttaacgttagtttaacgtacccggtaccggttaacccgttgtttcgtttcg

SEQ ID NO: 344507 - DNA, 579 bp, Homo sapiens
  misc_feature: GZ8MTXP01D5N6S.11.27.C05.1.454.CMB.2.raw
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (522)..(522): a, c, t, g, unknown or other
  misc_feature (522)..(522): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaacgtgggtcccgccaggcctccgaggggaggggctgggagtgggtctcagtcctattagtagtaatagtcgcctanagatactaacgcngactcactgaacggcgactcacntccacagacacaaacgcaaagacctcactgtaatcgtaggactaaatgaaactagccctaggacgaaacggccggaacggacacgggcttgtgttaccttaagttgacgggaccgaaaggngggttacgtaaccttaagttcgtcggtaccgggaaccccttaagttcgttttaacgg

SEQ ID NO: 344508 - DNA, 625 bp, Homo sapiens
  misc_feature: GZ8MTXP01EB7CI.11.27.C05.1.454.CMB.2.raw
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (538)..(538): a, c, t, g, unknown or other
  misc_feature (538)..(538): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctgggtggaggtcggtgggggaggccgtgggtcaaggccgttggggggtccctgagactctcctgcgcagcctcgtggacttccaccttcgaagttagtatagcagtagaacgtcgggtcccgccgaggccgtaccggaagggggaagggggtcgtaggggaggttgggtcctctaactcctaatttaaggtaagtaaatagtcgacctanagtatacctaacncaagactcacgtaggaacgggccactccactctcgacaagacgaaccaacgactaagactcactgtatctgaactaaagtcgaaactgacctgaacggacgccggaaggactacggntgttacgttataccgttggacggacggaggttacgacgttaacgtattccgtccgtaaccggggaacccctggttcgttttaaccgg

SEQ ID NO: 344509 - DNA, 557 bp, Homo sapiens
  misc_feature: GZ8MTXP01DIFIV.11.27.C05.1.454.CMB.2.raw
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcaccttcaagttagtatagctatagaacgtgggtcccgccaggcctccggaggggaagggggtctgggaggtcgggtctcattcctatttagtagtaatgtcgacctanagtatactaacgcngactcactgaacgggccactcacatcacagacganaaccgacaaagactcactgtatctagacaaatacgaacagcctaggagaacggtccgaaggacacggtctgttagttaatcgttgnggacgaggngngtctattaactcgtacggaaccctgttcgtttaacg

SEQ ID NO: 344510 - DNA, 543 bp, Homo sapiens
  misc_feature: GZ8MTXP01BTA0F.11.27.C05.1.454.CMB.2.raw
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaactgggtccgccaggctccgagggaaggggctggagtgggtctcatcctattagtagtaatagtcgcctanagatactaacgcngactcactgaacgggccgactccaccatcctaccagaacgacaaaccgccaaagaactcactgtatctggacaaatgaaacagcctgagacgccgaggacacggctgtgttattacgngtagcgaaggngaggtctagttaactcgtcggaaccccgtaagttgtttccg

SEQ ID NO: 344511 - DNA, 550 bp, Homo sapiens
  misc_feature: GZ8MTXP01AZ29V.11.27.C05.1.454.CMB.2.raw
  modified_base (362)..(362): a, c, t, g, unknown or other
  misc_feature (362)..(362): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggaggcctggtcaagcctggggggtccctgagactctcctgcgcagcctctggattcaccttcagtagtatagcatgaactgggtccgccaggctccgaggggaagggggctgggagtgggtctcatccattagtagtaatagtcgacctanagatactaaacgcaagactcactggaaggccactcaccatcnccagacgacaacgccaaagacncactgtactctaggcaaaagtcgaaacncgcctggacgacggacccggaggtaccgacgggctgtacgttattacgttgtgngagaggngctattaactcgtacggaccccgtaattcggtttc

SEQ ID NO: 344512 - DNA, 666 bp, Homo sapiens
  misc_feature: GZ8MTXP01BW73V.11.27.C05.1.454.CMB.2.raw
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggtttccttgttgctatttagaaggtgtccagtgtgaggtgcagctggtggaggtcgtgggggagccgtggtcaagccgtgggggtccctgagactctctgcgcagcctntgattcaccttcagtatanagcagtgacgtggtccncgngctcgaggggacggctggagtgggtctactactccgtagttaagtaagtaaagttagtcgacctaacgtaaagtactaacctaaccgacaacgtactaccgaacgtagggaaaccgggcccgtaactacccaacctatcccgtacgaaagaaaccgaacaaacccggacctaaaagtaaccctacaacgttatacgttacgtaggaaactaaagtacgaaacacgccgtaggaagaccggcggtaacggaccgtacggtgtaaggtctttaagtacgttggacggaacggttaaggaacggttcggtaactttaaatttaaccgttaccggtaacccgggttaaaaccccgttgtttaacccggtttttg

SEQ ID NO: 344513 - DNA, 599 bp, Homo sapiens
  misc_feature: GZ8MTXP01AX9U9.11.27.C05.1.454.CMB.2.raw
  modified_base (361)..(361): a, c, t, g, unknown or other
  misc_feature (361)..(361): n is a, c, g, or t
  modified_base (552)..(552): a, c, t, g, unknown or other
  misc_feature (552)..(552): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctacgcttgggtttttccttgttgcttattttagaaggtgtccagtgtgaggtgcagctggtggagtcgtgggggaggccgtggtcaagccgtggggggtccctgagactctcctgcgcagcctctggattcaccttcagtagtatagcatgaactgggtccgcaggctccgagggaagggctggagtgggtctcatccattagagtaatagtcgcctanagatactaacgcaagactacacgtggaacgggccgactacaccatcctacgagacgaacaaaccgaccaaacgaactcactagtatacctagggacaaaatcggaaactacgcccgtaagacgacggcccgaagggaaccgacgggtctggtagttaagttaccgttgggtacgaacggaggagggttacncttaattaacgtcgtaccgggttaaaccccgtaagttcgggtttaac

SEQ ID NO: 344514 - DNA, 754 bp, Homo sapiens
  misc_feature: GZ8MTXP01AOV00.11.27.C05.1.454.CMB.2.raw
  modified_base (258)..(258): a, c, t, g, unknown or other
  misc_feature (258)..(258): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggaggtcgtgggggaggcctggtcaagccgtgggggtccctgagctctcctgcgcngcctctgatcaccttcattagtatagcatgaacgtcgggtccgcaggctaccggaggggagggggctgggagtgggtctcatcctattagtaagtaatagtcgacctagagtactactaacgacaagtacctacgaacgtacgggaaccgggcccgtaacgtacccaccccgtactttacccgaccccgaaaggaaacccggtaaaccaaaaaccccggggacccctaaaaacggtaaaccccttaccgtaaaccgttagttaacttaccgttaagggaaacctaaaacggtacgaaacccgagaccccgtaaggaacgggaaacccggaccggggtaaacgggaacccggtaaccgggtcgtttaagggttaccgttttaaacggtttaaccggttgggttaacgggaacgggagggttaacggttacggttaactttaacgttaacgttacccggtaacccgggttaaaccccgttggtttcggtttttaaccg

SEQ ID NO: 344515 - DNA, 550 bp, Homo sapiens
  misc_feature: GZ8MTXP01C2KT4.11.27.C05.1.454.CMB.2.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
tcagcgagagataccacgaccggtgctcgatttagacgcgatcgaagggtttgggggagagaggagccttagccctggattccgaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttnagtagtatagcatgaactggtccncaggctcgagggaaggggctggagtgggtctcatcctattagtaagtaatagtcgacctacagtatactaacgacaagactcaacgtgaacggggccactccacccatcctaccagacgaacaaacgccaaaanaactcactntactcagaactaaagacgaacagccgagagacgacggaagacgacggtntgtagttattacgngtgcgaggngacgtaattattcgtcgtacggttaacctgttcgttg

SEQ ID NO: 344516 - DNA, 589 bp, Homo sapiens
  misc_feature: GZ8MTXP01DIH4Y.11.27.C05.1.454.CMB.2.raw
  modified_base (458)..(458): a, c, t, g, unknown or other
  misc_feature (458)..(458): n is a, c, g, or t
  modified_base (502)..(502): a, c, t, g, unknown or other
  misc_feature (502)..(502): n is a, c, g, or t
  modified_base (520)..(520): a, c, t, g, unknown or other
  misc_feature (520)..(520): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcaccttcagtagtatagcatgaactgggtccgcaggctccgaggggaggggctggagtgggtctcatccattagtagtaatagtcgcctacagatactaacgcaagactcactggaacgggccgactccacctatcctaccagacgaacaaacgccaaagaacctcactgtatctaggaacaaagtcgaacngcctagacgacgccggaaggacgacggcttcggtgttattacgnggttacgacggaaagggngggttaacgtaacctttaaagtttaacgtaccggtaccgggttaaacccccgttgttcggttttaaccg

SEQ ID NO: 344517 - DNA, 814 bp, Homo sapiens
  misc_feature: GZ8MTXP01AGYQ5.11.27.C05.1.454.CMB.2.raw
  modified_base (288)..(288): a, c, t, g, unknown or other
  misc_feature (288)..(288): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttatttagaaggtgtccagtgtgaggtgcagcgtgggtggaggtcggtgggggaggcctggtcaaggccgtgggggtcctgacgactctcctgcgcagcctctgacttcaccttcagtataanagctagtgaacgtcgggtccgccgtaggcctaccggaaggggaagggggtccgtaggggacgggttcggggttcctcgtaacgttcccgtaaagttttaagggttaaacgttaaacgttaaggttaccccgtaaccccgttaaaccgtaaagggtaaactttaaacccgttaaaacccggaaccgaaccggtaaccctttaaacccggaaccgttaacggggaaaccgggggacccggtaacctaccccgaacctaactccccgtaaccgaaggaaccggaaaccaaacccggaccgaaagtaaaccctcaaaccgttagtactaccgttaaggaacccgaaaagttcgaaacccgtaacgcccgtaagggaaccgacggggaccccgaaaggtaaccgcgggtccttaaggtagtttaacgtacggttcggttaaggaccggaaggttaccgggttaagttccctttaaaagttccggttaccggtaacccggggttaaccccttaaggttcgtttttaacccgg

SEQ ID NO: 344518 - DNA, 666 bp, Homo sapiens
  misc_feature: GZ8MTXP01C30WW.11.27.C05.1.454.CMB.2.raw
  modified_base (365)..(365): a, c, t, g, unknown or other
  misc_feature (365)..(365): n is a, c, g, or t
  modified_base (560)..(560): a, c, t, g, unknown or other
  misc_feature (560)..(560): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggtttccttgttgctatttagaaggtgtccagtgtgaggtgcagctggtggagtcgtgggggaggccgtggtcaagccgtgggggtccctgacgactctcctgcgcagcctctggattcaccttcagttagtatagcatcgaacgtcgggtccgccaggcctaccggagggaaggggctggagtgggtctcatccattagtagtatagtcgacctanagtactactaacgcaagactcactggaacgggccgactcaccctacgtccaccaagcgaaaccaaccgtccaaagtacctcactagttactacgttaggaacctaaagtacgaaaccgtacggtacccgtaggaacgaaccgggacccggaaggtacccgaacgggtccgttggttaacgtttacgtttaccggnggttacgggaccggaagggttacgggttaacggttccctttaaaggtttccgtacccgggttaacccggttaaacccccggttaagtttccggttttttaaccggg

SEQ ID NO: 344519 - DNA, 554 bp, Homo sapiens
  misc_feature: GZ8MTXP01BUS56.11.27.C05.1.454.CMB.2.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
tcagcgagagataccacgaccggtgctcgatttagacgcgatcgaagggtttgggggagagaggagccttagccctggattccaaggcctatccacttggtgatcggcactgagcaccgaggattcaccatggaactggggctccgctgggttttccttgttgctattttagaaggtgtccagtgtgaggtgcagctggtggagtcgtgggggagcctggtcaaggccgtgggggtccctgagactctcctgcgcagcctctggacttcaccttcagtagttanagcatgaactgggtccncaggctccgaggggagggctggagtgggtctcatccattagtagtaatgtcgcccctanagatactacgcagctcacgtgaacgggccactcaccactctccagacgacaacgaccaaagaactcacttagtactcgtgaactaaatacgaaaccacgcctagagacggaccgaggacacggcttgtaagttattcgtgttgacggaggagagcttaatacgtcgtacggaacccttgttcgttcgttttaag

SEQ ID NO: 344520 - DNA, 532 bp, Homo sapiens
  misc_feature: GZ8MTXP01AEUXR.11.27.C05.1.454.CMB.2.raw
  modified_base (300)..(300): a, c, t, g, unknown or other
  misc_feature (300)..(300): n is a, c, g, or t
  modified_base (401)..(401): a, c, t, g, unknown or other
  misc_feature (401)..(401): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
tcagcgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtcccncaggctccgagggaagggctggagtgggtctcatccattagtagtaatagtcgcctacagtatactaacgcaagactcactgaacggggcactcaccatcnccagagaacaaacgcctaaagactcactgtattcaggacaaatgaaacagtcnganagccgtaggacacggntgtgttatacgttgtcgacgttagagggntctattgttcacggaacccctgttcgtttg

SEQ ID NO: 344521 - DNA, 545 bp, Homo sapiens
  misc_feature: GZ8MTXP01A1RDE.11.27.C05.1.454.CMB.2.raw
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
  modified_base (494)..(494): a, c, t, g, unknown or other
  misc_feature (494)..(494): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaaggccgtggggggtccctgagactctcctgcgcagcctctggacttcaccttcagtagtatagcatgaactgggtccgcgaggctccgagggaagggggctgggagtcgggtctcactccgatttagtagtaactagtcgacctacgagtatactaacgacaagactcgactggaaacggccgactccaacnctaccaccagacgacaacgcaaagactcactgtaatcaggacaaacngaaacagcctagacgagcccgaggacaggntgtgttattacgngcgngagcgatctataacgtcgaccgacctgttcgtcg

SEQ ID NO: 344522 - DNA, 553 bp, Homo sapiens
  misc_feature: GZ8MTXP01C5X16.11.27.C05.1.454.CMB.2.raw
  modified_base (380)..(380): a, c, t, g, unknown or other
  misc_feature (380)..(380): n is a, c, g, or t
  modified_base (520)..(520): a, c, t, g, unknown or other
  misc_feature (520)..(520): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtcccgccgaggctccgagggaagggggcgtggaggtgggtctcatcctattagtagtaatagtcgcctacagatactaacgacngactcacttttaggaacgggccgactccaccactctaccagacgaacaaacgaccaacgaactacactagtatctggaacaatagaacacgcctagacgacgaccgaggacgacggcgtgtgttattacttgtgcgaggnggagctataatcgtcggacccgtcgttgtttcg

SEQ ID NO: 344523 - DNA, 567 bp, Homo sapiens
  misc_feature: GZ8MTXP01D3P4W.11.27.C05.1.454.CMB.2.raw
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagcctgggggtccctgagctctcctgcgcgagcctctaggacttcacttcagtagtatagcatgaacgtgggtccnccaggctccgaggggagggggctggagtgggtactcaatccaatttagtagtaatagtcgcctacagatactaacgcngactcaacgtgaacgggccactcaccatccaccagacgaacaaacggccaaagtaacctcaactgtaactctaggactaaaanagaacgacgcgngagacgaccggacgacgacggcgtgtgttagttacgttgtcggacggaggaggacgtaattattaacgtcgtacggttacccgtaacgttcgttcg

SEQ ID NO: 344524 - DNA, 686 bp, Homo sapiens
  misc_feature: GZ8MTXP01D9088.11.27.C05.1.454.CMB.2.raw
  modified_base (288)..(288): a, c, t, g, unknown or other
  misc_feature (288)..(288): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagctggtggagtcggtgggggagccgtggtcaagccgtgggggtccctgacgactctcctgcgcagcctcgtgacttccaccttcagttagtanagcagtagaacgtcgggtcccgccgaggccgtaccggaagggggaaggggctagggacggttcgggtctctactacctagtttagtaagtaagtagtccgacctaanagaactacctaacgacngactcacgtaggaacgggcccactaccacctatccacgaagaacaacctaaaccgaccaaagtaacctcaacgttacgtaactcgtaacggaaacctaaagtacgaaacgcgaccgaggaaggaccggacccggtaacggaccgtaaccgggtctttaaggttagtttaacggtttaccgttgggacggaacggttaagggaagggttacgttaactttagtttaaccgtcccggtaaccggggttaacccccttgtttaacggtttttcccgg

SEQ ID NO: 344525 - DNA, 614 bp, Homo sapiens
  misc_feature: GZ8MTXP01AY211.11.27.C05.1.454.CMB.2.raw
  modified_base (173)..(173): a, c, t, g, unknown or other
  misc_feature (173)..(173): n is a, c, g, or t
  modified_base (445)..(445): a, c, t, g, unknown or other
  misc_feature (445)..(445): n is a, c, g, or t
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
  modified_base (604)..(604): a, c, t, g, unknown or other
  misc_feature (604)..(604): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggactgggctccgctggtttccttgttgctatttagaaggtntccagtgtgaggtgcagctggtggagtcgtgggggagcctggtcaagccgtgggggtccctgagactctcctgcgcacgcctctgattcaccttcagtagtatagcatgaacgtcgggtcccgccaggcctaccgaggggaagggggcgtgggaggtgggtctcactacctagtttaacggtaagtaaagttacggtccggtaccttaacgaagtaactaaccgtaaaccggctaacgactacacgtaggaacgggcccgactccaaccctntcctacgaagaccgaacaaaccgacaaacgacctcacttgactactagggaacaaagtcaacgacgccgtagacgaacggccggaggacgacggtntgtgttactacgngtacggacgttaggaggcgtaacttagttaacgtcgtaccggacccgttnttcggtttcg

SEQ ID NO: 344526 - DNA, 608 bp, Homo sapiens
  misc_feature: GZ8MTXP01AWJ74.11.27.C05.1.454.CMB.2.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (458)..(458): a, c, t, g, unknown or other
  misc_feature (458)..(458): n is a, c, g, or t
  modified_base (543)..(543): a, c, t, g, unknown or other
  misc_feature (543)..(543): n is a, c, g, or t
tcagcgagagataccacgaccggtgctcgatttagacgcgatcgaagggtttgggggagagaggagccttagccccggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagttanagcatgaactgggtccncaggctccgaggggaacgggctgggagtgggtctcatccattagtagtaatagtcgacccctacagatactacgacagctcacgtgaacgggccactcactatctaccagacgaacaacgaccaaagtacctcactgtactctagacaaagtgaaacncgtaccaggacggacgacccggaggtaaccacgggtctggtaagttaacgtttaccgtaggttcggacgggaaggaacggggttnttaccttaatttaaccgtcgtacccgggtaaacccccgttatttcggtttcccgttttttaaggg

SEQ ID NO: 344527 - DNA, 715 bp, Homo sapiens
  misc_feature: GZ8MTXP01D2I6D.11.27.C05.1.454.CMB.2.raw
  modified_base (643)..(643): a, c, t, g, unknown or other
  misc_feature (643)..(643): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggacttccaccttcagttagtatagactagtacgaacgtcgggtcccgccgtaggccgtaccggaagggggaacgggggcgtggggaggttcggggtcctaccgtaactccgtaagtttaaggttaagttaaagttacggtaccgtacccttaacgaagtaactaacccgtaaaccgaccgaagtacctaccgaaacgttacgggaaacggggccccgtaaccttacccaaccctaacttccctaccgaaaggaaccgaaaccgaaaaccccggacccaaaacgtaacctacctaactagttaactctaggggaactaaagtacgaacgagtccgagacgacgtaccggaagaccgacgggtctggttagttaactttacgngtcggaacgttagggagggttactaacttaagttaacgtccggttaccgaaacccgttgttcgttttaaccg

SEQ ID NO: 344528 - DNA, 660 bp, Homo sapiens
  misc_feature: GZ8MTXP01AOCGA.11.27.C05.1.454.CMB.2.raw
  modified_base (287)..(287): a, c, t, g, unknown or other
  misc_feature (287)..(287): n is a, c, g, or t
  modified_base (639)..(639): a, c, t, g, unknown or other
  misc_feature (639)..(639): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttactattttagaaggtgtccagtgtgaggtgcagctggtggagtcgtgggggagcctggtcaaggccgtgggggtccctgagactctcctgcgcagcctctggtacttccaccttcagtagttanagcatgaacgtcgggtccgccgacggctaccggagggggaacggggcgtgggaggtcgggtctcgacttcctaatttaaggtaagttaagtagtcgtacccctaacagtactactacgacaacgtcctacgacgtacgggaacgggccactaccaacctatccctaccgagaacaaccaaacgacccaaagtaacctccattacgtactctacgaaacgaaatacgaaaccacggtacagggaacgacggacccggaaggaccgacgggtctagggttaacgtaactttcggtgttcgggaagtaagggacggttcggttactttaagtacgtcccgtacggaaccccgttnttcgtttaacgtttttaaggg

SEQ ID NO: 344529 - DNA, 600 bp, Homo sapiens
  misc_feature: GZ8MTXP01BXE8Y.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaacgtcgggtccgccgaggcctaccgaggggagggggctgggagtgggtctcatcctattagtagtaatagtcgcctacagactactaacgcaagtactcacgtaggaacgggccgactccaccatccaccagacacaaccgccaaagacctcactgtactctaggacaaagtcgaaactagcccgtaggacgacggccggaacggacgacggggcttaaggtacgttacgttacgttggtacggcgaagggttaggacgttccttaagttaaccgtcgtacccggggaaaccccttgtttaacgttttcg

SEQ ID NO: 344530 - DNA, 683 bp, Homo sapiens
  misc_feature: GZ8MTXP01AEQCW.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggtttcctgttgctatttagaaggtgtccagtgtgaggtgcagctggtggagtcgtgggggaggcctggtcaagccgtggggggtccctgagactctcctgcgcacgcctctggattccaccttcagtagtatagcatgaacgtcgggtcccgccgaggcctaccgaggggaagggggctagggaggttgggtctctaactcctaagtttagtaagtaaagtagtcgaccctacgagtaactaacgtaacgctaacgacctcaacgtagggaaacgggcccgtaactcccaacccaattccctaaccgaacggaacgaacccaaaccggacccaaagaacctcacctaggtaactactacggggaactaaacgtagaaaaccgacgcccgtagaacggaacggacccggtaagggaccgaaccggtcgttaacggtagtttaaccgttaacgttgggtaccggagggacggttaggacggttaacctaagtttcgtacccgtaccgggaaacccccgttgttaacggtttttccg

SEQ ID NO: 344531 - DNA, 667 bp, Homo sapiens
  misc_feature: GZ8MTXP01ED1R4.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtgggtggagtcggtgggggaggccgtggtacgaaggccggtcggggggtccctggacgtacctcctccgtgccgcacgccttcgtggacttcctaccttcaagttagtatagctagtacgaacgtcgggtcccgccgaggccgtaccgggaagggggaacgggggcgtaggggaggttcgggtctctatcctaagtttaagtaagtaagtagtccgacctaagacgtactaacgtaacgacaacgacctacgacgtacggaacgggcccactacccacatccacgagaacaacaacgacaaagacctcactgtaactcaggaactaaagtacgaacgcgtccaggaacgaccgaccggaacggaccgaccggtgttggttacgttacgttacgttggacggtacggaaggttgttacgttaacttacgttcgtaccggtaccggttaacccgttgttcgttttaacgg

SEQ ID NO: 344532 - DNA, 613 bp, Homo sapiens
  misc_feature: GZ8MTXP01B00W2.11.27.C05.1.454.CMB.2.raw
  modified_base (363)..(363): a, c, t, g, unknown or other
  misc_feature (363)..(363): n is a, c, g, or t
  modified_base (538)..(538): a, c, t, g, unknown or other
  misc_feature (538)..(538): n is a, c, g, or t
  modified_base (598)..(598): a, c, t, g, unknown or other
  misc_feature (598)..(598): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctatttagaaggtgtccagtgtgaggtgcagctggtggagtcgtgggggagctggtcaagccgtgggggtccctgagactctcctgcgcagcctctggattcaccttcagtagtatagcatgacgtgggtcccgccgaggctccggaggggaaggggcgtgggagtgggtctcatcctattacgtagtatagtcgacctanagactactaacgacaagactcacgtacggaacgggccacgtaccacctagtaccaccgagaacgaacaaaccgacaaacgaacctacacgtcgttaactcgtaggaactaaagtacgaacacgcctaggacgacggccgtaacgggaccacggtcgtaaggtcttaagttaccgnggtacggacgagggaggttacgtcttaacgttaacgttaccggtaaccggaccccggttnttccggtttttaacg

SEQ ID NO: 344533 - DNA, 545 bp, Homo sapiens
  misc_feature: GZ8MTXP01AKV13.11.27.C05.1.454.CMB.2.raw
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagttagtaatagcatgaacgtcgggtccgccaggcctccggaggggaagggggctgggacgtgggtctcatccattagtagtaatagtcncctanagatactaacgcaagactcacgtgaacgggtccgactcaccatccacagacacaacgcaagactcactgatcaggacaaatgaacacgctagaggacgccgagacgacggctgtgttatacgnggtcgagaggnggataacgtatcgtacgccgggacccctaagttcgtttaacg

SEQ ID NO: 344534 - DNA, 614 bp, Homo sapiens
  misc_feature: GZ8MTXP01EZMC5.11.27.C05.1.454.CMB.2.raw
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (384)..(384): a, c, t, g, unknown or other
  misc_feature (384)..(384): n is a, c, g, or t
  modified_base (532)..(532): a, c, t, g, unknown or other
  misc_feature (532)..(532): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtggtggagtcgtgggggaggccgtggtcaaggtccgtcggggggtccctgacgactctcctgcgcngcctctggattcaccttcagttagtanagcatgaacgtcggtaccgccaggctccggaggggaaggggctggagttgggtctacactcctaatttagtaagtaaactagtcgaccttanagtactactaacgcaacgctacacgtggaacggggccactccacctatcctaccgagaacacaaaccgaccaaacgaacctacacttagtactctaggaacaaagtacgaaacgcgacctaggagacgaccggtaacgacgaccggtnttggttattaacgttagttgtaggcgttaaggcgggactaactatttaactaccggtacggaccccttaagttcgtttaacg

SEQ ID NO: 344535 - DNA, 795 bp, Homo sapiens
  misc_feature: GZ8MTXP01EPWK7.11.27.C05.1.454.CMB.2.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (713)..(713): a, c, t, g, unknown or other
  misc_feature (713)..(713): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttatttagaaggtgtccagtgtgaggtgcagcgtggtggagtcggtgggggagccgtggtacaaggccgtgggggtcctgagctctcctgcncagcctctgtacttcaccttnagtagtatagcagtagaacgtcggtccgccgacggccgtaccggaaggggagggggcgtagggtaggtcgggtactccgtaactaccgtaagtttaaaggttaagttaaacgtacggtaccgacccgttaaacgagtaaaccttaacccgtaaaacccggacctaacggtaaccctaacccggtaaaccgggtaaggggaaaccccgggggtaccccgaaaccttacccaaaccccgtaacttaccccgaaccgaaacggaaaccgaaacccgttaaaacccggaacccaaaaagtaaccctcaaacgttcggttaaactccgtaaggggaaaccctaaaaagtaccgaaacgacggtacccaaggaacgggaaccggaccggaaaccggaccgtacggggtacttgggtttaacgtttaaacgtcgttggggaanacgggaaaggttacggaacctttaagttaactttaacggacccggttacccgggaaacccgtttgtttcgggttttaaccgg

SEQ ID NO: 344536 - DNA, 539 bp, Homo sapiens
  misc_feature: GZ8MTXP01EJ571.11.27.C05.1.454.CMB.2.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgagactctcctgcgcagcctctggattcaccttcagtagtanagcatgaactgggtccnccaggctccgagggaaggggctggagtgggtctcatccattagtagtaatagtcgcctacagatactaacgcaagactcactgaacgggccactcaccatctacaganacaacgaccaaagaactcactgtatctggacaaatagaacagcctagagacgccgaggacncggctgtnttattacgttgtcgcgagnggagtcttattctcgtacggaacccctaagttcgttttaacg

SEQ ID NO: 344537 - DNA, 647 bp, Homo sapiens
  misc_feature: GZ8MTXP01BNNTK.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaagccgtgggggtccctgagactctctgcgcagcctctgtattcaccttcagtagtatagcatgaacgtggtccgcaggctcgagggagggctaggagtgggtctacacttccgtatttaagtaagttaaataggtccgacctaacgagtaactaccgtaaacgacaagtaacctacgaaccgtagggaaccgggacccgtaactacccaccctaacgtcctaccgaagaacgaacgaaaccggaccaaagaacctccaacttgtaacttcgtacggaactaaaagtcgaaacgacgcccgtaggaagacgaccgtaacggaccgtacggtcgttaagtagttaattccgttggtacggtaacggaggttacggttacgtaacctttagttaacgtccgtaacgggaaacccctgttaagtttccg

SEQ ID NO: 344538 - DNA, 617 bp, Homo sapiens
  misc_feature: GZ8MTXP01BROY1.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctctgcgcagcctctggattcaccttcagtatatagcatgaacgtcgggtcccgccgaggcctaccggaggggaacgggggcgtagggaggtggggtctcgatcctagtttagtaagtaatacgtccgacctacagtactactaacgacaagactcacgtaggaacgggccgactaccacctatcctacgagacgaacaaccgaccaaagtacctacactgtactctaggaactaaagtgaaactcgcctaggaagaccggaccgtaaggaccacgggtcttaagtacgttattaccgttggtcggacgaagggaggacgttaaccttaagttcgtaccggtaccggaaccccgtaagtttcggtttaacg

SEQ ID NO: 344539 - DNA, 587 bp, Homo sapiens
  misc_feature: GZ8MTXP01EOUQD.11.27.C05.1.454.CMB.2.raw
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcaagccgtgggggtccctgagactctcctgcgcagcctctggattcaccttcagtagtatagcatgaactgggtcccgcaggctccgagggaggggctggagtgggtctcatccattagtagtaatagtcgcctacagatactaacgacaagactcacgtaggaacgggccgactcaccnttaccncaganaaccaaaccgacctaaagactcactgtaatcctaggaactaaagtcgaaactgaccngacgaacggccggaagtaccgaccggtntnttagttacttacgttgtacggacggaaggaggttaagtcttaagttaactaccggtaccggaaccccgttaagttcgttttaaccgg

SEQ ID NO: 344540 - DNA, 650 bp, Homo sapiens
  misc_feature: GZ8MTXP01AV53Z.11.27.C05.1.454.CMB.2.raw
  modified_base (408)..(408): a, c, t, g, unknown or other
  misc_feature (408)..(408): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctatttttagaaggtgtccagtgtgaggtgcagctggtggagtcgtgggggagcctggtcaagccgtgggggtccctgagactctcctgcgcagcctctggattcaccttcagttagtatagctatgaacgtgggtccgccaggctcgaagggaaggggctggagtgggtctcatcctattagtagtaatgtcacctacagaatctaaacgcaagactacgactaggaacgggccactcacctancctacagaacgacaaccgacaaagacctacacctaggtaactcgacggaactaaaagtcgaaaccagtcccgtaagacggaacggccggtaaacgggacctacgggggcttaagggttacggttaaacttttcgttcggttaacggtaccgggaaacgggttgggttaaccgtaacgtttaactttaaccgttacccgggttacccggaaaaccccggttgtttaaccgggtttttaaccgg

SEQ ID NO: 344541 - DNA, 756 bp, Homo sapiens
  misc_feature: GZ8MTXP01BG8DS.11.27.C05.1.454.CMB.2.raw
  modified_base (673)..(673): a, c, t, g, unknown or other
  misc_feature (673)..(673): n is a, c, g, or t
  modified_base (693)..(693): a, c, t, g, unknown or other
  misc_feature (693)..(693): n is a, c, g, or t
  modified_base (709)..(709): a, c, t, g, unknown or other
  misc_feature (709)..(709): n is a, c, g, or t
  modified_base (727)..(727): a, c, t, g, unknown or other
  misc_feature (727)..(727): n is a, c, g, or t
  modified_base (745)..(745): a, c, t, g, unknown or other
  misc_feature (745)..(745): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctgggtggagtcgtgggggagccgtggtcgaagccggtgggggtccctgacgactctcctgcgcagcctcgtggacttcctaccttcgtaagttagtatagctagtacgaacgtcgggtcccgaccgacggccgtaccgggagggggaacgggggtcgtaggggtagggttcgggtcctactacgttaccgtaagtttaacggttaagttaaagttacggttaccgacccttaaacgaaggtaaacttaacccgtaaaccgacctaacggtaccctaccgaaacggttacggggaaaccggggtaccccgtaaccttacccaacctaacgttcccgacccgaaaggaaccgtaaacccgaaaacccgaccctaaaagtaaccctactaaccgttagttaacttcccgaaggaaacctaaaaggtaccgaaactacgtaccgaggaagaacccgggaccggaacgggacctccggtnttaagtaggttacttacggnggtacggacggaaggngttaacgtaattacgttnacccggtacgaacccgtnttcgtttaacg

SEQ ID NO: 344542 - DNA, 622 bp, Homo sapiens
  misc_feature: GZ8MTXP01EIMJU.11.27.C05.1.454.CMB.2.raw
  modified_base (245)..(245): a, c, t, g, unknown or other
  misc_feature (245)..(245): n is a, c, g, or t
  modified_base (381)..(381): a, c, t, g, unknown or other
  misc_feature (381)..(381): n is a, c, g, or t
  modified_base (572)..(572): a, c, t, g, unknown or other
  misc_feature (572)..(572): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggtttttccttgttgcttattttagaaggtgtccagtgtgaggtgcagctggtggagtcgtgggggagcctggtcaagccgtgggggtccctganactctcctgcgcacgcctctgctattcacttcagtagtactagcatgaacgtcggtcccgcgagcgtcgaagggggagggcgtggaggtcggtcctactactacctaatttaagtaagtaacgtacgtcgactaanacgattaaacctacgcagtacctacaacgtaggaacgggcctaactccacattccaccaagtacgaaccaaccgactaacgaaacttcacgttagtactactaggaacaaatccgaaataacgccctaggaaaccggcgaccgttaacggacgcggtaattgttattaaacttgtaggtacgacgggttanacggtaactacttaacgtttcgacggttacccgtaacccgttgttttcgg

SEQ ID NO: 344543 - DNA, 820 bp, Homo sapiens
  misc_feature: GZ8MTXP01CGT3Q.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtggggagcctggtcagccgtgggggtcctgagctctcctgcgcagcctcgtgacttccaccttcagttagtatagcagtagacgtcgggtcccgccgaggcctccggaaggggaacgggggtcgtagggggaggttcgggggtaccttaccgaacgttacccgtaaagttttaaaggttaaagttaaaacgtttaggttaccccggtaccccttaaacgaacggtaaacttaacccgttaaaaccgggacctaacgggtaaccctaccgaaccggttacggggaaaacccgggggtccccgtaaacctacccaaacccctaactttacccgaaccccgaaaggaaaccgaaacccggaaaaccccgggtaaccccaaaaacggtaaacccttccgtaaacctttaacggtaacctttacccgttaaggggaaacctaaaacgttaacggaaacccgaagtaccccgtaggaacggaaccggacccggtaacggacccgtaccggttcgtaaggttacgttacgtttaacgttgggtacggcggaaggaggttacgtaactttacgtttaacgtaccgtacccgggttaacccgttgttcgtttttaaccgg

SEQ ID NO: 344544 - DNA, 621 bp, Homo sapiens
  misc_feature: GZ8MTXP01DUHSJ.11.27.C05.1.454.CMB.2.raw
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
  modified_base (550)..(550): a, c, t, g, unknown or other
  misc_feature (550)..(550): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
  modified_base (587)..(587): a, c, t, g, unknown or other
  misc_feature (587)..(587): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctgacttcaccttcagtagtatagcatagaacgtcggtcccgcgaggcctaccggaggggaacggggcgtagggagtgggtctcactctagttagtaataatagtccgacctanagtactaccgtaaacgacncgactacgaacgtaggaaaccggggccactaccaacctatacctaccaagaacgaacccaaaccggacctaaaacgtacctcctaaccgttagtactcctaagggaaccaaaagtcgaaacgcgaccgtagaagaccggtaccggacgacgaccggtnttcggtattacgttacgngtcgnggagttaggacgtnttatcgttacgacggttaccctgttcgtttaacg

SEQ ID NO: 344545 - DNA, 600 bp, Homo sapiens
  misc_feature: GZ8MTXP01AI8GE.11.27.C05.1.454.CMB.2.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
  modified_base (549)..(549): a, c, t, g, unknown or other
  misc_feature (549)..(549): n is a, c, g, or t
tcagcgagagataccacgaccggtgctcgatttagacgcgatcgaagggtttgggggagagaggagccttagccctggattccaaggcctatccacttggtgatcagcactgagcactgaggattcaccatggaacgtggggctccgcttgggttttccttgttgctattttagaaggtgtccagtgtgaggtgcagctggtggagtcgtgggggacgccgtggtcaaggccggtcgggggtccctgngacctctcctgcgcncgcctcgtggacttcctaccttcagtagtatagctatgaacgtcgggtccgaccgacggcgtccggagggggagggcgtaggaggtggtctcatctaattacgtatagtcgcactacganactaacacgcagactcgacgtgggaacgccgactaccactacgtacaccgagacaaccgaacgaccaaacacctactacgtacgttactacgggacaactaanacgaacncgaccgaggaccgacgaccgggaagaccgcggtcgtagttacgtaagttgtacggnggaggcgaagtctagttaactacgtacgttacgtaacccgttgttttccgg

SEQ ID NO: 344546 - DNA, 720 bp, Homo sapiens
  misc_feature: GZ8MTXP01C2RVE.11.27.C05.1.454.CMB.2.raw
  modified_base (285)..(285): a, c, t, g, unknown or other
  misc_feature (285)..(285): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtggtggagtcgtgggggagcctggtcaaggccgtgggggtccctgagactctcctgcgcagcctctgattccaccttcagtagtanagcagtgaacgtcggtcccgcacggctccgaggggaagggggctgggagtcgggtctctatcctagttaagtagttaatagtcgacctacagtactactaaccgacaagtactaccacggtaggaacgggacccgtactacccgaccctatcctacccgaagaaccgaaaccgaaaccgacccgaaagtaaccctaccaacttcggttaacttacccgtagggtaaacccaaaagttaccggaaactaccggtacccgtaaggacggaaaccgggaccgaacggaacccggtaaccgggtgttaaggttacggtttaaactttaccgggttgttacggggacggttaagggttaacggttacggttaacctttaaaggttaaccgttaccggtaacccggggttaaccccgttaaggtttcccggtttttaacgg

SEQ ID NO: 344547 - DNA, 633 bp, Homo sapiens
  misc_feature: GZ8MTXP01ES3IG.11.27.C05.1.454.CMB.2.raw
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (554)..(554): a, c, t, g, unknown or other
  misc_feature (554)..(554): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggagcctggtcaagccgtgggggtccctgagactctctgcgcagcctctgnttcaccttcagtagtanagcatgaacgtcgggtccgccaggcctccgaggggaaggggcgtggagtgggtctcatcctagttagtagtaatagtcgacctagagtactactaacgcaacgactcgacgtacggaacggggcccgactacccaccctactacctacccgagaaccgaacgaaacccgaccaaacgaacctacacttagtactcgtacggaactaaagtacgaaactacgaccctaggacgaacggtccggaaggtaacgcgggtcctggttacgttagtttcgnggtacggacgaaggggcgaacggttcttaagtttaaccgtacggttacccggaaaccccgttgtttccggttttaaccg

SEQ ID NO: 344548 - DNA, 676 bp, Homo sapiens
  misc_feature: GZ8MTXP01B7TQQ.11.27.C05.1.454.CMB.2.raw
  modified_base (262)..(262): a, c, t, g, unknown or other
  misc_feature (262)..(262): n is a, c, g, or t
  modified_base (375)..(375): a, c, t, g, unknown or other
  misc_feature (375)..(375): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggagcctggtcaagccgtgggggtccctgagactcctcctgcgcagcctntggattccaccttcagtagtatagcagtgaacgtgggtcccgcgaggcctaccggaaggggaggggcgtgggaggtgggtctcatcctattagtaagtaatagtccgacctanagtactaccgtaacgcaacgtacctacgaacgtacgggaaacggggcccctaactacccaacccgtacttcccgtacccgaaaggaaccgaacccgaaacccggacccaaaacggtaaccctaccgtaacttagtaactccgttacggaaactaaaagtcgaaacgacgtacccaggaacggacggacccgggaacggaccgacggtctaaggttagttacttacgttggtcggacggttaggacggttagtaactttaagttaactaccggtaccggaaccccgtaagtttcgtttaacg

SEQ ID NO: 344549 - DNA, 583 bp, Homo sapiens
  misc_feature: GZ8MTXP01D4DHM.11.27.C05.1.454.CMB.2.raw
  modified_base (533)..(533): a, c, t, g, unknown or other
  misc_feature (533)..(533): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggaggcctggtcaaggccgtgggggtccctgagactctcctgcgcagcctctggattcaccttcagtagtatagcatagaacgtgggtcccgccaggcctccggagggaggggctggagtgggtctcatccatttagtagtaatagtcgacctacgagtatacctaacgcaagactcaacgtggaaacggccactccaccatcctacagacgaacaaaccgccaaagactcgactgtatccgtggactaaagcgaacagcctagacgacgaccggaaggaccgacggtctaaggttagttacttaacgttgtcggagaggnggttataacttagttcgtaccgtaccgggaaaccctgttaacgttttccg

SEQ ID NO: 344550 - DNA, 560 bp, Homo sapiens
  misc_feature: GZ8MTXP01DX3BO.11.27.C05.1.454.CMB.2.raw
  modified_base (359)..(359): a, c, t, g, unknown or other
  misc_feature (359)..(359): n is a, c, g, or t
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactggtccgccaggctccgagggaaggggcgtggagtgggtctcatccattagtataatagtcacctanagatactaacgcaagactcacgtagaacgggccgactccacatctacagacgacaaccgacaaacgactacactgtacnctaggactaaagtnaaacgagctagagacgccgaaggactacggctaagtcttagttaacgttgtcgacggaggaggagtccttagttaactccgtacggaaccccgtaagttcgtttaacg

SEQ ID NO: 344551 - DNA, 630 bp, Homo sapiens
  misc_feature: GZ8MTXP01BFBX1.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggaggcctggtcaagccgtgggggtccctgagactctcctgcgcagcctcgtggattcaccttcagtagtatagcatgaacgtgggtccgccgaggcctcccgaaggggaagggggctgggacggtgggtctcatccagtttaagtagtaaataggtcgacctaacgagactacaacgcaaggactcaacgtaggaacggggcccaacgtccacctatacctaccaaggaacgaaccaaaccggtaccaaagtaaccctccaacttgtaacttccgtaggaactaaatacgaaacacggccctaggacgacggaccggtaaggacccgaacggtcgtggttggttaacttacgttggaggcgaaggttcggagttaatacgttaatccgacggttaccccgtaattcgttttaaccgg

SEQ ID NO: 344552 - DNA, 954 bp, Homo sapiens
  misc_feature: GZ8MTXP01AR6Q8.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcaagccgtgggggtccctgagactctcctgcgcagcctcgtggacttcaccttcagttagtatagcatgaacgtcgggtccgccgaggccgtacccggaagggggaacgggggtcgtggggaggttcgggggtctacgtacttacccgtaagttttaaggtaaagttaaacgttaggtccggtaacccctttaaacgaacggtaaacttaaacccgttaaacccgggaccgtaacggtaaacccctttacccggaaaccggtttaaccgggggtaaaaacccggggggtcccccgaaaccccgtttaacccccaaaccccgttaaacccgttacccctttaacccccggaaaacgggaaaacccgggaaaaccccgaaaaaccccggggtaacccccaaaaaaccggtaaaaccccgtttacccctaaaccgtttaacgggtttaaccttacccgttaaccggggaaaacccttaaaaaacggttaaccggtaaaaccccgtaacccggtaccccggtaaggtaaaccggggaaaccgggaaccccggggtaaacgggggaaaccccgtaaacccggggtccgtttaacgggtttagtttaaacggtttaaacccggtttgggtacgggtaacccgggaagggttaacggggttaaggttaaccctttaagtttaaccgtcccggttaaaccggggttaaccccccgttaagtttccggtttttaacccggg

SEQ ID NO: 344553 - DNA, 612 bp, Homo sapiens
  misc_feature: GZ8MTXP01C2OVM.11.27.C05.1.454.CMB.2.raw
  modified_base (329)..(329): a, c, t, g, unknown or other
  misc_feature (329)..(329): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaagtgtccagtgtgaggtgcagcgtggtggagtcgtgggggagcctggtcaagccgtgggggtccctgacgactctcctgcgcagcctctgattcaccttcagtagtatagcatagaacgtggtcccgcaggctcgagggaggggctggagtggtctnactccattagtagtaatagtcgcctaacngactaacgtaacgancgactcgactagggaacgggccctactcaccntccaccagacgaacaaacgtaccaaagaactcaactgtaattccgaagacaaagtcgaacgcgaccaggacgacggaccggaacggtaccgacggtcgttaagttacgttaacgttcggagtacgggacgttaagggttacgttacggtaacctttaacgttcggttacccggtaacccgggttaacccgttaagtttcggttaacg

SEQ ID NO: 344554 - DNA, 700 bp, Homo sapiens
  misc_feature: GZ8MTXP01DQ3QC.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagctctgattcacttcagtagtatagcatgaacgtcggtccgcaggctccgagggaaggggtctggagtgggtctcgatccattagtagtaatagtcgcctacagataccgtaacgacaagactacactaggaaacgggccgactccacctagtcctaccgaaggaacgaaaccaaaccgacccaaaagtaacccttacgaaccttaggtaaactttaccccgaggggtaaaccctaaaagttaaccgggaaaaccaacggccccgttaggaaacggaaccggaacccggtaacggggtaacccgaacggggtcctttaagttaaccgggtttaatttaaacccggttggttaggacccgggaaaaggttggggttaaacccgtctttaaagttaacgtttaccccgacggggttaaaaccccctgtttaacccgggtttttaacg

SEQ ID NO: 344555 - DNA, 615 bp, Homo sapiens
  misc_feature: GZ8MTXP01DTQT7.11.27.C05.1.454.CMB.2.raw
  modified_base (531)..(531): a, c, t, g, unknown or other
  misc_feature (531)..(531): n is a, c, g, or t
  modified_base (577)..(577): a, c, t, g, unknown or other
  misc_feature (577)..(577): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggagcctggtcaagccgtgggggtccctgagactctcctgcgcacgcctctgattcaccttcagttagtatagcatgaacgtcggtccgcgaggctccgaggggaaggggcgtgggagtgggtctcgactcctattagtaagtaatacgtcgcctaacagtaactacaacgcaagactcacgtaggaacggccgactccaccatcctaccgagacaaccaaacgaccgaaagacctacaccgttgtactccgtgaaactaaagtacgaaaccgtacgcccgtagaggaacgccggaaggaccgaacggtcgttaaggtnttagttacgttggtacggacgaaggaggttacgtaattaaacgttnttaccggtaaccggaaccccttaagttccgttttaacg

SEQ ID NO: 344556 - DNA, 530 bp, Homo sapiens
  misc_feature: GZ8MTXP01CVDM6.11.27.C05.1.454.CMB.2.raw
  modified_base (360)..(360): a, c, t, g, unknown or other
  misc_feature (360)..(360): n is a, c, g, or t
  modified_base (481)..(481): a, c, t, g, unknown or other
  misc_feature (481)..(481): n is a, c, g, or t
tcagcgagagataccacgaccggtgctcgatttagacgcgatcgaagggtttggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaagccgtggggggtccctgagactctcctgcgcagcctctggattcaccttcagtagtatagcatgaactgggtccgcaggctccgagggagggggctggagtgggtctcatccattagtagtaatagtcgcctanagatactaacgcaagactcactgaagggccactcacatctccagagacaacgcaaagactcactgtatctggacaaatgaacagcctgagacgccgaggtacacgggctgtcgttattacngtcgcgagcggagctaattctctagggaaccccgtaagttcgttaaccg

SEQ ID NO: 344557 - DNA, 586 bp, Homo sapiens
  misc_feature: GZ8MTXP01B0FUS.11.27.C05.1.454.CMB.2.raw
  modified_base (373)..(373): a, c, t, g, unknown or other
  misc_feature (373)..(373): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
  modified_base (497)..(497): a, c, t, g, unknown or other
  misc_feature (497)..(497): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
  modified_base (542)..(542): a, c, t, g, unknown or other
  misc_feature (542)..(542): n is a, c, g, or t
  modified_base (553)..(553): a, c, t, g, unknown or other
  misc_feature (553)..(553): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggaggccgtggtcaaggccgtggggggtccctgacgactctcctgcgcacgcctctggattccaccttcagttagtatagcatgaacgtgggtccgccaggcctccgaggggaaggggcgtggaggtgggtctcatccagttagtagtaatgtcgcctanagatacctaacgcaagactcacgtaggacggccgactccaccatccncaganaccaacncaaagacctacactgtactctagggacaaagtanaacacgccgtagacggacgccggaacggacncggtctgggtacttagtttaacnggtacggcgaagnggttacgtntaagtttaacncgtaccgggttaacccctgttaacgttttccgg

SEQ ID NO: 344558 - DNA, 652 bp, Homo sapiens
  misc_feature: GZ8MTXP01DEE3S.11.27.C05.1.454.CMB.2.raw
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtggtggagtcggtggggaggcgtggtcaaggccgtgggggtccctgacgtactctcctgccgcacgtcctcgtggtacttccgtaccttcgtagttagtataggactagtagtaacgtcgggtccccgcgacggcctaccggaggggaagggcgtaggaggtcgggtctctatactattagtaagtaatagtacncctanagtactactaaacgctaagacctacgaacgtacgggaacggaccgactacccactatccacagaacgaacctaaccgaccaaagacctacgacttgtactcctagggaactaaagtacgaaacgacgtccgaggacgaacggacggtacgacgcgtcgttgttacgttagttacgttggtacgtacgaggaggttctaacctttaagttaaccgtacccggtaacggttacccctaagtttccggttttaacg

SEQ ID NO: 344559 - DNA, 550 bp, Homo sapiens
  misc_feature: GZ8MTXP01CE70M.11.27.C05.1.454.CMB.2.raw
  modified_base (427)..(427): a, c, t, g, unknown or other
  misc_feature (427)..(427): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaaggccgtggggggtccctgagactctcctgcgcagcctctggattcaccttcagtagtatagcatgaactgggtcccgcaggctccgagggaaggggctggagtgggtctcatccattagtagtaatagtcgcctacagatactaacgcaagactcacgtgaagggcccactcacatctcagacgacaaacgccaaagacncactgtatctggacaaatgaactagcctgacgagccgaaggacacggtctaaggtgttattacgngtagcgaaggnggactcgtaattaagtccgtacgggaacccctaagttcgtttaaccg

SEQ ID NO: 344560 - DNA, 655 bp, Homo sapiens
  misc_feature: GZ8MTXP01EAXOB.11.27.C05.1.454.CMB.2.raw
  modified_base (146)..(146): a, c, t, g, unknown or other
  misc_feature (146)..(146): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
  modified_base (552)..(552): a, c, t, g, unknown or other
  misc_feature (552)..(552): n is a, c, g, or t
  modified_base (611)..(611): a, c, t, g, unknown or other
  misc_feature (611)..(611): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgntggttttccttgttgcttatttagaaggtgtccagtgtgaggtgcagctggtggagtcggtgggggagcctggtcaagccggtgggggtccctgacgactctctgcgcagcctntgattcaccttanagtagtatagctagtacgaacgtcgggtcccncgaggcccgtaccggaaggggaaggggtcgtagggacggttgggtctacgtacgtaccaaagttttaagtaagttaaagtacgtaccgtacccctaaagtaacgaactttacccaaaaccggcaaggtaccttaccgaaacggtcgggaaaacggggccctaaactcccaacctntacccnccgaagtaacgaaccaacgtacaaataccctacagtactataccgtaggaaactaaatacgaaacngcccgaaggaacgacggaccgtaaggacgaccgttgtaagtagttaactgttaggcggngaggttcgattctagtaacttcggaccgaccgtttgttcgtttg

SEQ ID NO: 344561 - DNA, 738 bp, Homo sapiens
  misc_feature: GZ8MTXP01B5XOU.11.27.C05.1.454.CMB.2.raw
  modified_base (659)..(659): a, c, t, g, unknown or other
  misc_feature (659)..(659): n is a, c, g, or t
  modified_base (670)..(670): a, c, t, g, unknown or other
  misc_feature (670)..(670): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgagtgcagcgtggtggagtcggtggggaggcctggtcaaggccgtcgggggtccctgacgactctcctgcgcacgcctctgacttccaccttcgagttagtatagcagtgaacgtcggtcccgccgacggcctccggaaggggaacggggcgtgggtaggttgggtcctacgtattaccgtaagtttaagttaagtaaagttagtaccgaccttaagagtaactaccgttaaccgacaacgtacctacacggttacgggaaccgggcccctaacgtcccaacctacttcccgaacccgagaaaccgaacccgaaacccgaaccgaaacgtaaccctacgtaacgttagttacttaccgaaggggtaactaaaagttacgaaaccgtacgtaccccgagggaaaccggaccggaccggaacgggacctaacggggttcttaagggttactttaccgttaagttggtaacgggngttaaacgggnggttacgttaacctttagttaaccgttaccggtaccggttaaaccccgttgtttcggtttttaaccgg

SEQ ID NO: 344562 - DNA, 597 bp, Homo sapiens
  misc_feature: GZ8MTXP01ANVBH.11.27.C05.1.454.CMB.2.raw
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (437)..(437): a, c, t, g, unknown or other
  misc_feature (437)..(437): n is a, c, g, or t
  modified_base (473)..(473): a, c, t, g, unknown or other
  misc_feature (473)..(473): n is a, c, g, or t
  modified_base (523)..(523): a, c, t, g, unknown or other
  misc_feature (523)..(523): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtgggggtccctgagactctcctgcgcagcctctggattcaccttcagtagtatagcatgaactgggtccnccaggctccgaggggagggctggagtgggtctnatccattagtataatagtcncctanagatactaacgcaagactacactaggaacggggtccactacaacccatcctacgaagacaacgaaccgccaaagtaacncgactcgtaactctagggacctaaatcgaaaacccngaccgagacgacggaccggaacgacgtcggcttaagtacgttagttacgnggtcggacggaaggttcggttacgtaacttaacgtaacggttccgtaccgggttaaccccgtaagttcgtttcg

SEQ ID NO: 344563 - DNA, 599 bp, Homo sapiens
  misc_feature: GZ8MTXP01BM180.11.27.C05.1.454.CMB.2.raw
  modified_base (282)..(282): a, c, t, g, unknown or other
  misc_feature (282)..(282): n is a, c, g, or t
  modified_base (527)..(527): a, c, t, g, unknown or other
  misc_feature (527)..(527): n is a, c, g, or t
  modified_base (546)..(546): a, c, t, g, unknown or other
  misc_feature (546)..(546): n is a, c, g, or t
  modified_base (562)..(562): a, c, t, g, unknown or other
  misc_feature (562)..(562): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggagcctggtcaagccgtgggggtccctgagactctcctgcgcagcctctggattcaccttcagtagtanagcatgaacgtcgggtccgcaggcctaccggaggggaaggggcgtggtaggtgggtctcgatcctattagtaagtaatagtcgacctacagaactaccgtaaacgcaacgtactactacggtaacggaacgggcccgactacccactactcctacaagaccgaacaaacgaccaaagactacacttgtactcaggaacaaatacgaacgtacgccaggacaacggaccggaaggtaccgacggtntaaggttgttacgttacgngtacggagagggttgngtaactagttcacgtccgggaaaccctgttcgtttcg

SEQ ID NO: 344564 - DNA, 651 bp, Homo sapiens
  misc_feature: GZ8MTXP01DRCFK.11.27.C05.1.454.CMB.2.raw
  modified_base (595)..(595): a, c, t, g, unknown or other
  misc_feature (595)..(595): n is a, c, g, or t
  modified_base (606)..(606): a, c, t, g, unknown or other
  misc_feature (606)..(606): n is a, c, g, or t
tcagcgagagataccacgaccggtgctcgatttagacgcgatcgaagggtttgggggagagaggagccttagccccggattccaaggcctatccacttggtgatcagcactgagcaccgaggattcaccatggaactggggctccgcttgggtttttccttgttgctattttagaaggtgtccagtgtgaggtgcagctggtggagtcgtgggggaggcctggtcaaggccgtgggggtccctgacgactctcctgcgcacgcctgtggacttcaccttcagttattatagcagtcgaacgtcgggtcccgccgaggcctaccggagggggaacggggtcgtggggaggttgggtctacacttctaagtttagtaagttaaataggtcgtacccctaacaagtaactaacctaaccgacaagtaacctacgacgtaacgggaaaccggggtcccaacctaccaaccctactcctaccgaagaacgaaccaaacggacccaaaagaacctacacttagtaactctaagaacaaacgtacgaaaccgcgacctagaggacgaccggaagtacgacggtcgtgtaattacttcgtggngacggagaggnttacttaattactcgtaccgaacccttgttcgttcgttttaacgg

SEQ ID NO: 344565 - DNA, 633 bp, Homo sapiens
  misc_feature: GZ8MTXP01A09SL.11.27.C05.1.454.CMB.2.raw
  modified_base (386)..(386): a, c, t, g, unknown or other
  misc_feature (386)..(386): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagtagtatagcatgaacgtgggtcccgccgaggctccggaggggaaggggcgtggaggtgggtctcatcctattagtagtaatagtcgacctacagtactactaacgacncgactcacgtaggaacgggccgactacaccctatcctaccaggacgaacaaaccgaccaaagacctcaacttgtactccgtaggaacaaagtacgaaacgacgtcccgtaggaggaccggccggaaacgggaccgaccgggtcgtaaggtttagttaacgtttacgttggttacggacggaaggaggggacttaacttaagtttaacgtacccggtaccgggaaaccccgttgttcgttttaaccgg

SEQ ID NO: 344566 - DNA, 698 bp, Homo sapiens
  misc_feature: GZ8MTXP01DA2G6.11.27.C05.1.454.CMB.2.raw
  modified_base (309)..(309): a, c, t, g, unknown or other
  misc_feature (309)..(309): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgctattttagaaggtgtccagtgtgaggtgcagcgtggtggagtcggtgggggagtccgtggtcaaggccgtgggggtccctggacgactctctgcgcacgcctcgtgtacttcaccttcagttagtatagcatgaacgtcggtccncgaggccgtaccggaggggaaggggcgtgggagtcgggtctacactactagttagtaagtaaagtagtccgaccttacgagtaactaacctaacgacaagtactacaacgtacgggaaccggcccgactacccaactacttccaacccgaagaaccgaaccaaaacccggaccgaaacgtaaccttacaaccgttagtaactttgaaaccgggtactaaaaacgtagaaacccgacggtcccgaagggaacgaaccggggaaccgtaagggtaacccgacccggattttggtaagttaaactttccgggttagtaccggacggggagttaacgggataacccgtttaagtaacttcggtacccgggaaaccccttgttccgttttaagg

SEQ ID NO: 344567 - DNA, 746 bp, Homo sapiens
  misc_feature: GZ8MTXP01AR885.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtccctgagactctctgcgcacgcctctggatcaccttcagtagtatagcagtgaacgtcgggtcccgccgaggccgtccgaaggggaacgggggcgtgggaggtggggtctacacgtcctaagtttaaggtaagtaaagttagtaccgacctaacaaggtaactaacccgtaaacgcgaagtaacctcgaacgtacggaaacggggtacccgtaacctacccaaccctacttaccgacccgaaacgaaccgaaacccgaaacccggaaccccaaaacggtaaaccctaccttaaaccgtaggttaacgttacccttacggggaaactaaaagtaacgaaaccgaacgacccgtaggaacggaccgggacccggaacgggaacccgaacgggtccgttaagttaggggggttaacttacggttggtaggtaacggaagggttagggttacgtaacgttaacgttaacgttacccggttacggttaacccccgtgtttcgtttttaaccggg

SEQ ID NO: 344568 - DNA, 570 bp, Homo sapiens
  misc_feature: GZ8MTXP01C9RV2.11.27.C05.1.454.CMB.2.raw
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (416)..(416): a, c, t, g, unknown or other
  misc_feature (416)..(416): n is a, c, g, or t
  modified_base (532)..(532): a, c, t, g, unknown or other
  misc_feature (532)..(532): n is a, c, g, or t
tcagcgagagataccacgaccggtgctcgatttagacgcgatcgaagggtttggaggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaagccgtgggggtccctgagactctcctgcgcagcctctggacttcaccttcagtagttatagcatgaactgggtccnccaggctccgaggggaagggctggagtgggtctcgattccaattagtagtaatacgtcgactanagataactacgcagactcacgtggaacgggccgactcaccagtcctacagaanaaccgaaacgaccaaagacctcaactagtactcgtagaactaaatacgaaacagtcctagaacggacgaccggagaccgaacggtctgttgttacttcgtgtcgagagagggtaanacttaattacgtcgttacggtaaccccgttaagtttcg

SEQ ID NO: 344569 - DNA, 766 bp, Homo sapiens
  misc_feature: GZ8MTXP01BYSI8.11.27.C05.1.454.CMB.2.raw
  modified_base (702)..(702): a, c, t, g, unknown or other
  misc_feature (702)..(702): n is a, c, g, or t
  modified_base (719)..(719): a, c, t, g, unknown or other
  misc_feature (719)..(719): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagctggtggagtcggtgggggagccgtggtcagccgtgggggtccctgagactctcctgcgcagcctgtgacttccaccttacgtagttagtatagctagtacgtaacgtcgggtccccgaccgacggtccgtaccgggaaggggaacggggtcgtagggtaggttcgggtcctacgtaacgttaccgttaaagtttaacggttaaagttaaacgttacggtacccgtaacccttaaagaacgtaaccttaaccgttaaccggaaccgtaacggtacctaaccgtaaccgggttaacgggaaacccggggtaccccgtaacctacccaacccgtaacgttcccaaccggaagaaaccggaaaccctaaacccggaaaccgtaaacgtaaccttcctaacgttaggtaacttaccgtaaggaaactaaaagtacgaaaccgcgtaccgacggaacgaacccgggccggaaagtacccgtaccggtgttaacggttacgttaacgttcgnggtacgaggttaacggnggttactgttaacttccgtcgtaccggttaccttgtttcgtttaacg

SEQ ID NO: 344570 - DNA, 626 bp, Homo sapiens
  misc_feature: GZ8MTXP01CAFQK.11.27.C05.1.454.CMB.2.raw
  modified_base (371)..(371): a, c, t, g, unknown or other
  misc_feature (371)..(371): n is a, c, g, or t
  modified_base (489)..(489): a, c, t, g, unknown or other
  misc_feature (489)..(489): n is a, c, g, or t
  modified_base (536)..(536): a, c, t, g, unknown or other
  misc_feature (536)..(536): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattccaccttcagtagtatagcatgaactgggtcccgccaggcctaccggaggggaacggggcgtgggaggtgggtctcactcctattagtagtaatagtcgacctanagtactactaacgcaagacctacgactaggaacgggcccgactccacctattccaccgagacgaaccaaaccgaccaaagacctcaactgtactctaggaacctaaaagtcgaaaccncggtaccctaggaacggaccggaccggaaggaacccgtaccggggtnttaacggttgtttaacgttacgttggttacggcgttaaggaggttagtccttattaacgtcgtaccggttaacccctgtttcgtttaacg

SEQ ID NO: 344571 - DNA, 569 bp, Homo sapiens
  misc_feature: GZ8MTXP01DYQC9.11.27.C05.1.454.CMB.2.raw
  modified_base (374)..(374): a, c, t, g, unknown or other
  misc_feature (374)..(374): n is a, c, g, or t
  modified_base (460)..(460): a, c, t, g, unknown or other
  misc_feature (460)..(460): n is a, c, g, or t
  modified_base (526)..(526): a, c, t, g, unknown or other
  misc_feature (526)..(526): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcaccttcagtagtatagcatgaacgtggtccgccaggctccgaggggaagggctggagtgggtctcgatccattagtagtaatagtcgcctacagatacgtaacgacngactcgactacggaacggggccactcaccatcctacagacacaaccgacaagactcactgtactctaggaactaaagtcgaaaccngtacccgagaacggaacgaccggtagaccgacgggtctaagttacgttattacgttgcgaggaagnggagtcttaagttctcgtaccgggacccctaagttcgttttcg

SEQ ID NO: 344572 - DNA, 611 bp, Homo sapiens
  misc_feature: GZ8MTXP01EOLQZ.11.27.C05.1.454.CMB.2.raw
  modified_base (536)..(536): a, c, t, g, unknown or other
  misc_feature (536)..(536): n is a, c, g, or t
  modified_base (555)..(555): a, c, t, g, unknown or other
  misc_feature (555)..(555): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagccgtggtcaagccgtgggggtcctgagactctcctgcgcagcctctgattccacttcagtatatagcatgaacgtcgggtcccgcaggctccggaggggaggggcgtggagtgggtctcatcctatttaagtagtaatagtcgacctaagagtaactaccgtaacgacaacggactaccgacgtacgggaacgggacccgactacccaacccattccaccgaagacgaaaccaaaccggaccaaagtaaacctcactagtacttctaggaactaaagtacgaacgtacgcccgtaggacgacgaccggaggaccgacgntaaggtagttacttgttgngacgttaggcgttagtcttaaattcgtccgacggttaacccgtgtttcgtttaacg

SEQ ID NO: 344573 - DNA, 564 bp, Homo sapiens
  misc_feature: GZ8MTXP01AT8FE.11.27.C05.1.454.CMB.2.raw
  modified_base (358)..(358): a, c, t, g, unknown or other
  misc_feature (358)..(358): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggattcaccttcagttagtatagcatgaacgtggtccgcaggctccgaggggagggctggagtgggtctcatccattagtagtaatagtcgacctanagtatactaacgcaagactcaacgtggaacgggccgaactccaccatccacagacacaacgccaaagactcatgtatccaggacaaatcgaacacgtcccgagacgaacggccggtaacggacgaacggtcgtgttgttacgtacgttggtacgacggttaggacgggataacctagttaactcgtacggacccctgttcgtttcg

SEQ ID NO: 344574 - DNA, 728 bp, Homo sapiens
  misc_feature: GZ8MTXP01DZLOV.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggttttccttgttgctattttagaaggtgtccagtgtgaggtgcagctggtggagtcgtgggggagcctggtcaagccgtgggggtccctgagactctctgcgcagcctctggattccaccttcagtagtatagcatagaacgtcgggtcccgaccgaggcctcccggaaggggaacgggggtccgtagggaaggttgggggtcctcgtaacttacccgtaatttaaggttaagttaaagtacggttacgaccccttaaacgaaggtaaacttaacccgtaaaccggactaacggtaaccctccgtaaacgttacgggaaaccgggggaccccgtaacttacccaaccctaattccccgaacccgaaagggaacaaacccgaaaaccggaccaaaaacgacctaccgtaaccttaggttaaattcccgttaagggaaaccctaaaagttacgaaaccgagtccccgtaggaacggaacggtcccggaaggaccgccgggtcttaagttacgttattaccgttggcgagaaggcggttatcttaacgttcgttccgaccgggaaccccttgttcgttttccg

SEQ ID NO: 344575 - DNA, 552 bp, Homo sapiens
  misc_feature: GZ8MTXP01CCPRT.11.27.C05.1.454.CMB.2.raw
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
  modified_base (527)..(527): a, c, t, g, unknown or other
  misc_feature (527)..(527): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaacgtgggtccgccaggctcggagggaggggcgtgggagtgggtctcatcctattagtagtaatagtcncctanagtatactaacgacngactacacgtagaacgggccgactcaccattcaccaagacacaaccgcaaagacctcacttntatcgtaggaactaaatcgaaaccngacccgtgaacgaccgacgaggaccacggctggtattattcgngtgcgagnggatctattcncgtacggaccctaattcgtttaacg

SEQ ID NO: 344576 - DNA, 594 bp, Homo sapiens
  misc_feature: GZ8MTXP01A5OUM.11.27.C05.1.454.CMB.2.raw
  modified_base (374)..(374): a, c, t, g, unknown or other
  misc_feature (374)..(374): n is a, c, g, or t
  modified_base (441)..(441): a, c, t, g, unknown or other
  misc_feature (441)..(441): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggacttcaccttcagttagtatagcatgaacgtcgggtccgccgaggcctccggaggggaaggggcgtgggaggtgggtctcactacctattagtagtaatagtccacctanagatacgtaacgcaacgactcacgtagaacgggccactccacatccacagacacaacgacaagtacncatgtatcgagacaaatcgaactagccgagacgacgccgaaggaccgacgtcgtgttgttaaagttcgttaggtcggaggttagggacggttacgttaaccttaagtttaaccgtaccggttacccgggaaaccccgttgtttccgttttccg

SEQ ID NO: 344577 - DNA, 679 bp, Homo sapiens
  misc_feature: GZ8MTXP01ATOAW.11.27.C05.1.454.CMB.2.raw
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (396)..(396): a, c, t, g, unknown or other
  misc_feature (396)..(396): n is a, c, g, or t
  modified_base (598)..(598): a, c, t, g, unknown or other
  misc_feature (598)..(598): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaaggccgtgggggtccctgagactctcctgcgcagcctcgtgacttcaccttnagtagtanagcagtacgacgtcgggtaccncgaggcctaccggaggggacgggcgtagggagtcgggtctacgtactaccgtagtttaaggtaacgttaaagtagtacccgtacctaanagtaactacgtaacgccaacgtactacgacgtacggaaccgggaccgtacctaccgaaccctattacccgtaaccgaaggtaaaccgaacccgaaaccccgacgtaaaacgtacctacgtaacctgtaactccgtaaggaacttaaagacgaaccagtcccgtaggaaccgtacggcccggtaaacgggactaacccgggtnttaacgtacgttaagtaccgttggacgtacggaggttacgacgtgttaactcgacggtacgaaacccttgttcgttaacgg

SEQ ID NO: 344578 - DNA, 556 bp, Homo sapiens
  misc_feature: GZ8MTXP01EGV91.11.27.C05.1.454.CMB.2.raw
  modified_base (403)..(403): a, c, t, g, unknown or other
  misc_feature (403)..(403): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgagggaaggggctggagtgggtctcatccattagtagtaatagtcgcctacagatactaacgcaagactcactgaacgggccgactcaccatcncagagacaacgcaaagacncactntatctggacaaatgaaacagccctgacgacgtccgaaggaccacggctgttgttatttacgttgtggcggaaggcgggagtcgttaatttaactcgtaccggggaaacccctaagttcggttttaaccg

SEQ ID NO: 344579 - DNA, 637 bp, Homo sapiens
  misc_feature: GZ8MTXP01A6MU3.11.27.C05.1.454.CMB.2.raw
  modified_base (281)..(281): a, c, t, g, unknown or other
  misc_feature (281)..(281): n is a, c, g, or t
  modified_base (479)..(479): a, c, t, g, unknown or other
  misc_feature (479)..(479): n is a, c, g, or t
  modified_base (616)..(616): a, c, t, g, unknown or other
  misc_feature (616)..(616): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcaagccgtgggggtccctgagactctcctgcgcagcctctgattcaccttcagtagtanaacatgaacgtgggtcccgccgaggccgtccggaagggggaacggggtcgtaggggaggttggggtcctcgacgttcctaagtttagtaagttaaataggtcacccccttaacgagtactaacctacgaacacgtaacctcacgtaggaacggggcccactcaacctatcctacgagacaaccaacgaccaaagaccncgacttgtactactagaactaaaagtgaaaccgagtccgaggaacgacgaccggacggaccgacgtcgttgtaagttaacttacgtggttgaacggagagggttacgttctttaagttacgtccgaaccggtacccngttaacgtttcgttttaacgg

SEQ ID NO: 344580 - DNA, 699 bp, Homo sapiens
  misc_feature: GZ8MTXP01ELRPX.11.27.C05.1.454.CMB.2.raw
  modified_base (286)..(286): a, c, t, g, unknown or other
  misc_feature (286)..(286): n is a, c, g, or t
  modified_base (661)..(661): a, c, t, g, unknown or other
  misc_feature (661)..(661): n is a, c, g, or t
  modified_base (686)..(686): a, c, t, g, unknown or other
  misc_feature (686)..(686): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgctattttagaaggtgtccagtgtgaggtgcagctgggtggagtcgtgggggagccgtggtcaagccgtgggggtccctgagctctctgcgcacgcctctggattccaccttcaagttagttanagctagtacgaacgtcggggtccccgaccgagggcctacccgggaagggggaacgggggtcgttaggggacgggttcggggttacctaccgtacgttaccgtaagttttaaaggtaagttaaagtacggtacgaccccttaagaacgaactaacccgttaaacgaccaacgtacctaccaacgtacgggaaccggggccctactacccaacctactccaaccgaagaacgaaccctaaacgacctaaaacgactaccaacgttatactacgtacggaaactaaaacgtgaaaccgcgtacccgtagaacggaacggccgaaggttaccgaaccgtgttaagtacgttattaacgttggacgaggagaggttactntaacttgtaccgtaccgttaaccgngtttcgtttaacg

SEQ ID NO: 344581 - DNA, 773 bp, Homo sapiens
  misc_feature: GZ8MTXP01ET60L.11.27.C05.1.454.CMB.2.raw
  modified_base (267)..(267): a, c, t, g, unknown or other
  misc_feature (267)..(267): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagtccgtctgtntctaccttacagtagtatagacagtacgtacgtcgggtcccgaccgacggaccgtaccggaagggggaacggggtcggtacggtaggtacggtaccgtactacgtacgtaagttaaggttaagtaacgttacgtacgtaccgtaacgtaacgtaaactaaccgtaaccgacgaacgtaaccgtaccgtaacggtaacgggaaaccgggtaacccgtaaccgtaacccgtaaccctaacgtacccgtaacccgaaacggaaaccgaaaccgaaaccgaaacccgaaacgtaaaccgtaaccgtaacgtaacgttaacgtacgtaacgtaaacgtaaacgtaaacgaaacgtaacgtaccgtaacggaacggtaacggaaccggtaaccggaacggtaaccggtacgttacggttaacgttaacgttaacggtacggttacggacggaacgggtaaggtaacgtaacgttaacgttacgttaccggtaacccgggttaacccgtaacg

SEQ ID NO: 344582 - DNA, 572 bp, Homo sapiens
  misc_feature: GZ8MTXP01D1ZTR.11.27.C05.1.454.CMB.2.raw
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (462)..(462): a, c, t, g, unknown or other
  misc_feature (462)..(462): n is a, c, g, or t
  modified_base (513)..(513): a, c, t, g, unknown or other
  misc_feature (513)..(513): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtacaagccgtgggggtccctgagactctcctgccgtnacgcctcgtaggattccacccttnagttagtanagctagagaactgggtcccncgagcctccgaggaggggctggagtgggtctcgatcctatttagtaagtaatgtcgccctaagagattactaacgcaagactccgaacgtaggaacggcccgactacaccatctcaagacgtaacaaacggcctaaagaactcaaaccgttntatctagaactaaagtacgaacgcgcaggacgacgacggtagcctacggtntaagttgttatacgttgagagaggttgataattatcgtcgaccgttaccgtgttcgttg

SEQ ID NO: 344583 - DNA, 638 bp, Homo sapiens
  misc_feature: GZ8MTXP01AS710.11.27.C05.1.454.CMB.2.raw
  modified_base (393)..(393): a, c, t, g, unknown or other
  misc_feature (393)..(393): n is a, c, g, or t
  modified_base (513)..(513): a, c, t, g, unknown or other
  misc_feature (513)..(513): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggttttccttgttgctatttagaaggtgtccagtgtgaggtgcagctggtggagtcgtgggggaggcctggtcaaggccgtgggggtccctgagactctcctgcgcagcctctggacttcaccttcagtagtatagctatgaacgtcgggtcccgccgaggcctccggaagggggaagggggcgtggggaggttcggggtcctacgacttaccgtatttaaggtaagtaattaggtccgtacctanaagtatacctaaacgcgaagacctacgacgtaggaacgggaccgactaccaccactctaccgaagaacgaacaaaccgaccaaagaaccacactagaacttcgtaggacaaatcgaaacncgccgtaggacgacggaccgaaggtaccgcggtacgttgtacgttagtacgttggtcggaggaacgggaggttacgttaacttacttaacgtaccggtaccgggaaacccctgttcgttttaacg

SEQ ID NO: 344584 - DNA, 482 bp, Homo sapiens
  misc_feature: GZ8MTXP01A2T9T.11.27.C05.1.454.CMB.2.raw
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (422)..(422): a, c, t, g, unknown or other
  misc_feature (422)..(422): n is a, c, g, or t
  modified_base (462)..(462): a, c, t, g, unknown or other
  misc_feature (462)..(462): n is a, c, g, or t
  modified_base (464)..(482): a, c, t, g, unknown or other
  misc_feature (464)..(482): n is a, c, g, or t
tcagcgagagataccacgaccggtgctcgatttagacgcgatcgaaggggctggagtgggtctcatccattagtagtaatagtgcctacagatactacgcagactcactgaagggccgactcaccatctccagagacaacgccaagaactcactgtatctgacaaatgaacagcctgagagccgaggacacggctgtgtattacgtgtgcgagaggagtctattatcgtacggaaccctatgtcttttgagtttcgnggggacaaggacatgctcaccgtctctcncgcctccaccgacggccacgtccgtcctccccgcgccctaccctcctacaacgacgccaccgtccggcggggcacgcggcccgtccgcgggctcgtacccgtggtacgaacggtaccttaccttcgtactccgtcncgtcgtggcggccgggctcgggacgaaggccgagtaatgngnnnnnnnnnnnnnnnnnnn

SEQ ID NO: 344585 - DNA, 696 bp, Homo sapiens
  misc_feature: GZ8MTXP01CE1WO.11.27.C05.1.454.CMB.2.raw
  modified_base (291)..(291): a, c, t, g, unknown or other
  misc_feature (291)..(291): n is a, c, g, or t
  modified_base (627)..(627): a, c, t, g, unknown or other
  misc_feature (627)..(627): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtacagtgtgaggtgcagcgtggtggagtcgtgggggaggcctggtcgaaggtccggtgggggtccctgacgacctctctgcgcacgcctcgtgacttccacttcagtagtanagcagtagaacgtcgggtcccgcgaggcctcggaggggaacggggcgtagggtacggtcgggttctacgtaacttacctaagtttaaggtaaagttaaagttacgtaccccgtacccgttaacgaacgtaactaaccgtaaaccgacaacgtacctaacctaacgggtacgggaaccggccccgaactccaaccctagtacccgaacgaagaacgaaacccgaaaccgaccaaagtaaccctagacttacgatccgtaggaactaaagtccgaaacgtcgccgaggacggaccggcggtaagaccgtcgggtacttgggttacttagtttacgggnggtacggacggaggttgttacttaacgttaagtccgtacggtaccggttaccgttaagttcgtttaacg

SEQ ID NO: 344586 - DNA, 632 bp, Homo sapiens
  misc_feature: GZ8MTXP01DA10Q.11.27.C05.1.454.CMB.2.raw
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (530)..(530): a, c, t, g, unknown or other
  misc_feature (530)..(530): n is a, c, g, or t
  modified_base (581)..(581): a, c, t, g, unknown or other
  misc_feature (581)..(581): n is a, c, g, or t
  modified_base (586)..(586): a, c, t, g, unknown or other
  misc_feature (586)..(586): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttatttagaaggtgtccagtgtgaggtgcagctggtggagtcgtgggggaggcctggtcaagccgtgggggtccctgagactctctgcgcagcctctggattcaccttcaagtagttatagctatgaacgtgggtcccgccaggcctcccggaaggggaagggggtctgggtaggtcggggtctcgtatcctattaagtacgtaataggtcnccgtanaaggtataaccgtaaacgcaacgtacttaccacgtacggaaacgggccgacttaccacctacttccaccaaggaacacctaaaaccggcccaaaaggtacctactactacgtataccgtaggaactaaagtacgaaccgagacccgnggacggacgcccggagggtaccacggcgttaagtgttaatcgttggtacgnggagngggataaccttaaattcgtcgtaccggaacccgttgttcttttcgg

SEQ ID NO: 344587 - DNA, 549 bp, Homo sapiens
  misc_feature: GZ8MTXP01AEKDP.11.27.C05.1.454.CMB.2.raw
  modified_base (299)..(299): a, c, t, g, unknown or other
  misc_feature (299)..(299): n is a, c, g, or t
  modified_base (418)..(418): a, c, t, g, unknown or other
  misc_feature (418)..(418): n is a, c, g, or t
  modified_base (478)..(478): a, c, t, g, unknown or other
  misc_feature (478)..(478): n is a, c, g, or t
tcagcgagagataccacgaccggtgctcgatttagacgcgatcgaagggttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccncaggctccgagggagggctggagtgggtctcatccattagtagtatagtcgacctagagtatacctaagcaagactcgatgaaggggccactcacatctcagagacaacgacaaagacncactagatctaggacaaatgaaacctagccctagaggacgaccggtacggacgtaccggntgtgttatacgttgtacgacggaggagttaggtctagttaactccgtacggacccctaagttcgtttaacg

SEQ ID NO: 344588 - DNA, 747 bp, Homo sapiens
  misc_feature: GZ8MTXP01DUVDQ.11.27.C05.1.454.CMB.2.raw
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
tcagcgagagataccacgaccggtgctcgatttagacgcgatcgaagggtttggaggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaagccgtgggggtccctgagactctcctgcgcagcctntggacttcaccttcagtagtatagcatgaacgtcggtccncagctacgaggggagggctggagtggtctcgatcctattaagtagtaatacgtcgactacagtaactaacctacgcagtacctacgaccgtacgggaacggggtcccgtaacctacccaacctactacccaccgaaggaaaccgaaaccgtaaacccggaaccctaaaacggtaacccttaccctaacgttaaggttaacctttaccgggtaacggtaaactaaaacgttacggtaaaccgacgaccccgttaagggaaaccggacgggtaaccccgggaagggacccgtaacccggggttcgttggggtttaacgtttaaaccgtttcggttacggggttcggaaaacgggttagggaaaccgggggttaagttaaaccctttaaaggttttacccggtacccggttaaacccggggttaaaaccccccgttggtttttaacccggg

SEQ ID NO: 344589 - DNA, 689 bp, Homo sapiens
  misc_feature: GZ8MTXP01CA60V.11.27.C05.1.454.CMB.2.raw
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (527)..(527): a, c, t, g, unknown or other
  misc_feature (527)..(527): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggtttccttgttgctatttagagtgtccagtgtgaggtgcagctggtggagtcgtggggagcctggtcaaggccgtgggggtccctgagactctcctgcgcacgcctcgtggtacttctaccttcagtagtatacgctagtagaacgtcgggtcccgccgaggcgtaccggaaggggaacggggtcgtagggtaggtcgggtaccttcgactccgtaagtttaacgtaagttaagtacgtcgtacctanaagtactactaacggacncgactacacgtacggacgggccactacacctatacctacgaaggaaccaacgaacccgaacgtaaacgaccttacacttagtactacctggggaaactaaagtacgaaacgngtacccaggacggacggcgtaacggaccgaccggttgtaaggttagttaccgttacgttggggttacgtaccgggaagggttcgggttaacccttggtttaaactttaaccgtcccggggtaaacccggttaccccgttaaggtttccgttttttaacccgg

SEQ ID NO: 344590 - DNA, 685 bp, Homo sapiens
  misc_feature: GZ8MTXP01EA67V.11.27.C05.1.454.CMB.2.raw
  modified_base (618)..(618): a, c, t, g, unknown or other
  misc_feature (618)..(618): n is a, c, g, or t
  modified_base (647)..(647): a, c, t, g, unknown or other
  misc_feature (647)..(647): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcggtggggagtccgtggtacgaaggtccggtcgggggtccctagacgtacctctccgtgcgcacgtcctcgtaggtacttcctacttacgtaagttagtaatagactagtacgtaacgtcgggtcccgacgaggaccgtaccgggaaggggtaacgggggtcgtagggggttagtcggggttctacgtaacttaccgttaagtttaacgttaaagttaaagtacggttccacccgtaaacgtagtaactaaccgtaaccgacaacggtacctacgtacgtaggaacgggtaccgacttacccacgtacttacccacgaagaacaacccgaaacaccgaaactacctactactagtactacgtaggaaacctaaagtacaacgtcgacgtagacgacgaccggagacgcgtntgtattatcgttgagacgaggttgacgtnttacgttaagtccggaccgttacgtgttcgttttaacg

SEQ ID NO: 344591 - DNA, 608 bp, Homo sapiens
  misc_feature: GZ8MTXP01DUVJ5.11.27.C05.1.454.CMB.2.raw
  modified_base (384)..(384): a, c, t, g, unknown or other
  misc_feature (384)..(384): n is a, c, g, or t
  modified_base (427)..(427): a, c, t, g, unknown or other
  misc_feature (427)..(427): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (528)..(528): a, c, t, g, unknown or other
  misc_feature (528)..(528): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggtttccttgttgctattttagaaggtgtccagtgtgaggtgcagctggtggagtcgtgggggagcctggtcaaggccgtggggggtccctgacgactctcctgcgcagctctgattcacttcagtagtatagcatagactggtccgcaggcctccgagggaagggcgtaggacggtgggtctacgataccgtagtttacgtaagtatacgtcgacctaagagtactactaaccgnaacgactcgaactaggaacgggccactaccaccattccacganacgaacaaacgtccaaagtaaccnactatataccnggtaacaagtcaaacgcgtacngacgaacgccggaagacnccgggtntgggtacttaaaccgttgngggttagaccgggttaaagttggggattcggttaaactttcgtaccgggtaccggaaacccgttgttaacccgtttttgg

SEQ ID NO: 344592 - DNA, 620 bp, Homo sapiens
  misc_feature: GZ8MTXP01DZAHN.11.27.C05.1.454.CMB.2.raw
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttcctgttgctattttagaagtgtccagtgtgaggtgcagctggtggagtctgggggaggcctggtcaagcctggggggtccctgagactctcctgcgcagcctctggattcaccttcagtagtatagcatgaactgggtaccncaggctccaggggaaggggctggagtgggtcncaatccattagataaatagtcgcctaanagactaacaacgacaacgtactacacgtacggaacggtcctaactaccaacgtactcctaccgaagaacaaccgaaacgaccaaaagtaacaccacgtatactcgtaggactaaataacgaacaacgacgacgaacgaacgaccggaacggaacgacggtcgtcgttacgttagttaacgttacgtaggtacggaacggaacgggaacggtaacttaacgttaacgttacgtaccggttaacccgtaaccgttaacgttaacg

SEQ ID NO: 344593 - DNA, 669 bp, Homo sapiens
  misc_feature: GZ8MTXP01E3CG2.11.27.C05.1.454.CMB.2.raw
  modified_base (425)..(425): a, c, t, g, unknown or other
  misc_feature (425)..(425): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttatttagaaggtgtccagtgtgaggtgcagctgggtggagtcggtgggggaggccgtggtcaaggccggtgggggtccctgagtacctctcctgcgcacgcctcgtggtacttcctaccttcgaagttagtatagctagtacgtaacggtcgggtccccgccgacggtccgtaccgggaagggggaacgggggcgtaggggaggttgggtcctactacgtacctaagtttagtaagtaaacgttagtaccgtacctaanagtaactacgtaacgacaacgtacctactacgtacggggaacggcccgaactaccaccactccaccgaagaacaacgaaaccacaaacgactacactacgtataccgtaggaaacaaagacgaaacacgtaccgaggaacggacggaccggtaacggaccggtacgcgttaaggtagttaccgtgttgtacggacggagagttgtaatagttaactcgaccggttacctaagttcgtttaacgg

SEQ ID NO: 344594 - DNA, 580 bp, Homo sapiens
  misc_feature: GZ8MTXP01BQ57Q.11.27.C05.1.454.CMB.2.raw
  modified_base (276)..(276): a, c, t, g, unknown or other
  misc_feature (276)..(276): n is a, c, g, or t
  modified_base (386)..(386): a, c, t, g, unknown or other
  misc_feature (386)..(386): n is a, c, g, or t
  modified_base (530)..(530): a, c, t, g, unknown or other
  misc_feature (530)..(530): n is a, c, g, or t
  modified_base (537)..(537): a, c, t, g, unknown or other
  misc_feature (537)..(537): n is a, c, g, or t
  modified_base (550)..(550): a, c, t, g, unknown or other
  misc_feature (550)..(550): n is a, c, g, or t
  modified_base (572)..(572): a, c, t, g, unknown or other
  misc_feature (572)..(572): n is a, c, g, or t
  modified_base (580)..(580): a, c, t, g, unknown or other
  misc_feature (580)..(580): n is a, c, g, or t
tcagcgagagataccacgaccggtgctcgatttagacgcgatcgaagggtttggggggagagaggagccttagccctggattccgaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttnagtagtatagcatgaactgggtaccgcaggctacgaggggagggctggagtgggtctcgattccgatttaagtacgtaaatagtcgacccgtacagtataacgttaaacncaagtacctacaacctgggaacgggacccagtaccaccactactaccagaacgaacaacgaccaaacgactacactatatcctagggactaatagaaacagccgagagacgcggaacggactaacggcgtgtagttaaacgttnaggtcgngaggagttagggntattaatgtacggacccgtaanccggtttn

SEQ ID NO: 344595 - DNA, 530 bp, Homo sapiens
  misc_feature: GZ8MTXP01EBS87.11.27.C05.1.454.CMB.2.raw
  modified_base (249)..(249): a, c, t, g, unknown or other
  misc_feature (249)..(249): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (473)..(473): a, c, t, g, unknown or other
  misc_feature (473)..(473): n is a, c, g, or t
  modified_base (496)..(496): a, c, t, g, unknown or other
  misc_feature (496)..(496): n is a, c, g, or t
tcagcgagagataccacgaccggtgctcgattttagacgcgatcgaaggggtttgggggagagaggagccttagccctggattccaaggcctatccacttggtgatcagcactgagcaccgaggattcaccatggaactggggctccgctggggttttccttgttgctattttagaaggtgtccagtgtgaggtgcagctggtggagtctgggggaggcctggtcaagcctggggggtccctgagactntcctgcgcagcctctgggattcacttcagtagtacagcaatgaacctgggtccgccaggctccaggggaaggggctggagtgggtcacatccgattagagtaaatgcccncanagatacaancnanacangaggacgacncacanctcanagacaacgacaacgaacacactatatactgtactaaataagaacacgacgtagagacgaccggacggacgacgngtgtgttattagttagtgcgagngagaactataactcgtcgaccgtaacgttcgtcg

SEQ ID NO: 344596 - DNA, 592 bp, Homo sapiens
  misc_feature: GZ8MTXP01DPNSK.11.27.C05.1.454.CMB.2.raw
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
tcagcgagagataccacgaccggtgctcgatttagacgcgatcgaagggtttggggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggaggcctggtcaaggccgtggggggtccctgagactctcctgcgcagcctctggacttccaccttcagttagtatagcatagaacgtcgggtccgccaggccgtccggaagggggacggggcgtagggaggtcgggtctcatcctagtttagtaagttaataggtcacctanagtaactacaaacgacngaacctcgaacgtggaacggggcccactccaccatccacagaacaacaaccgaccaaagacctacactgtatctacggacaaagttgaaaccagcccgagaacggacgaccggtaggaccgacggtctaagttagttattacgngtgacgagnggataattataactcggacgttaccctgttgtttcg

SEQ ID NO: 344597 - DNA, 617 bp, Homo sapiens
  misc_feature: GZ8MTXP01AY6WK.11.27.C05.1.454.CMB.2.raw
  modified_base (284)..(284): a, c, t, g, unknown or other
  misc_feature (284)..(284): n is a, c, g, or t
  modified_base (542)..(542): a, c, t, g, unknown or other
  misc_feature (542)..(542): n is a, c, g, or t
tcagcgagagataccacgaccggtgctcgatttagacgcgatcgaagggtttggggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcaccttcagtatanagcatcgaatcgggtccgccaggctccgaggggaacggggctgggagtgggtactccaatccgtattacgtagtaaatagtccgcccttaagagaactactaaacggcaagactacgaactggaacgggtccaactcacctagtacctaccgaagaacgacctaaaccggcctaaaacggactaacgactaggttactactacggggactaaagcgaaacgtacgaccttaggagaacgcccgtaaggacaccggggntcgtaggttacttacgttgtacgccgagttcggagtaacctagtcgttcgacggaccccgtaagttcggtttaac

SEQ ID NO: 344598 - DNA, 512 bp, Homo sapiens
  misc_feature: GZ8MTXP02GXPMD.11.27.C05.1.454.CMB.2.raw
  modified_base (300)..(300): a, c, t, g, unknown or other
  misc_feature (300)..(300): n is a, c, g, or t
  modified_base (452)..(452): a, c, t, g, unknown or other
  misc_feature (452)..(452): n is a, c, g, or t
  modified_base (469)..(469): a, c, t, g, unknown or other
  misc_feature (469)..(469): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtcccctgagactctcctgcgcagcctctggattcaccttcagtagttatagcatgaactgggtccnccaggctccagggaaggggctggagtggggtctcatccattagtagtaaatagtgcctacagatactacgcagactcactgaaggggccactcaccatctccagagacaacgccaaagaactcactgtatctgcaaatgaaccagcctaganagccgagacacggctgngtatactgtgcgagagagctatatctaggaaccccgatcgtcg

SEQ ID NO: 344599 - DNA, 518 bp, Homo sapiens
  misc_feature: GZ8MTXP02HUUFB.11.27.C05.1.454.CMB.2.raw
  modified_base (299)..(299): a, c, t, g, unknown or other
  misc_feature (299)..(299): n is a, c, g, or t
  modified_base (411)..(411): a, c, t, g, unknown or other
  misc_feature (411)..(411): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccaggggaaggggctggagtggggtctcgatccattagtagtaatagtcgcctacagatactacgcagactcactgaaggggccgactccaccatcctaccaganacaacgccaaagaactcactgtatctgacaaatgaaacagcctagagagccgaggacacggctgtgtatactgtgcgagaggagctatactcaggaccctatcgtcg

SEQ ID NO: 344600 - DNA, 499 bp, Homo sapiens
  misc_feature: GZ8MTXP02JR5AR.11.27.C05.1.454.CMB.2.raw
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
tcagcgagagataccacgaccggtgctcgatttagacgcgatcgaagggtttggggagagaggagccttagccctggattccaaggcctatccacttggtgatcagcactgagcaccgaggattcaccatggaactgggctccgctgggttttcctgttgctattttagaaggtgtccagtgtgaggtgcagctggtggagtctggggagcctgatcaagcctgggggtccctgagactctcctgcgcagcctctggattcaccttcagtagttatagcatgaactggtccgcaggctccagggaagggctggagtgggtctcatccattagtagtaatagtgcctacagatactagcagactcactgaagggccactcaccatctccagagacacgccaagaactcactgtatctgcaaatgaacagcctgagagccgagacacggctgtgtatactgtcgcgagaggngcttatactcgtacggaaccccgtntacg

SEQ ID NO: 344601 - DNA, 521 bp, Homo sapiens
  misc_feature: GZ8MTXP02HU0SV.11.27.C05.1.454.CMB.2.raw
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
  modified_base (368)..(369): a, c, t, g, unknown or other
  misc_feature (368)..(369): n is a, c, g, or t
  modified_base (397)..(397): a, c, t, g, unknown or other
  misc_feature (397)..(397): n is a, c, g, or t
  modified_base (494)..(494): a, c, t, g, unknown or other
  misc_feature (494)..(494): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttcctgttgctattttagaaggtgtccagtgtgaggtgcagctggtggagtctgggggaggcctggtcaagcctgggggtccctgagactctcctgcgcgagcctctggattcaccttcagtagttatagcatgaactgggtccncaggctccgaggggaaggggctggagtggggtctnatccattagtagtaatagtgcctacagatactacgnngactcactgaaggggccactcaccatcncagacgacaacgccaagaactcactgtatctagacaaatagaacacgaccagagagacgacggacgacgcgtcgtgtattactgtcggcgagagagngtatactactacgaccgtacgtcgtcg

SEQ ID NO: 344602 - DNA, 527 bp, Homo sapiens
  misc_feature: GZ8MTXP02FUS4N.11.27.C05.1.454.CMB.2.raw
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggtccgccaggctccgagggaaggggctggagtggggtctcgatccattagtagtaaatagtgcctacagatactacgcagactcactgaagggccgactcaccatctccagagacaacgccaaagaactcactgtaatctagacaaatgaaacagccctagacgagccgaggacacggctgtgtattactgtgcgagaggagcttatactcgtacggaaaccccgntcgtttcg

SEQ ID NO: 344603 - DNA, 546 bp, Homo sapiens
  misc_feature: GZ8MTXP02JPV6Y.11.27.C05.1.454.CMB.2.raw
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaggggctggagtgggtctcatccattagtagtaatagtcgacctacagatactacgcagactcactgaacgggccgactcaccntccnccaganacacgaccaagaactnactgtatctgacaatagaacagcctagagacggccgaaggactacggctagtgttaattcgtgggcgacgaggagtagtaacgtacgttacgtacgtaccggtaacccgtgttcgtttcg

SEQ ID NO: 344604 - DNA, 520 bp, Homo sapiens
  misc_feature: GZ8MTXP02I3VW4.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtggggtctcatccattagtagtaaatagtgcctacagatactacgcagactcactgaagggccgactcaccatctccagagacaacgccaaagaactcactgtatctgacaaatgaacagccctgagagccgaggaccaggctagtgtattactgtgcgagaggagcgtattactctaggaaccccgatcgttacg

SEQ ID NO: 344605 - DNA, 524 bp, Homo sapiens
  misc_feature: GZ8MTXP02INISA.11.27.C05.1.454.CMB.2.raw
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgaggggaaggggctggagtggggtctcgatccattagtagtaaatagtcgcctacagatactacgcagactcactgaacgggccgactcaccatctaccagagacaacgccaaagaactacactgtatctagacaaatgaacaagccctagacgagccgaagacacggctgtgttatactgtgcgagagacgntatactcagaacccntcgttcg

SEQ ID NO: 344606 - DNA, 538 bp, Homo sapiens
  misc_feature: GZ8MTXP02G4QE5.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcacccttcagtagttatagcatgaactgggtccgccaggctccgaggggaaggggctggagtgggtctcgatccattagtagtaatagtcgcctacagatactacgcagactcactgaacggggccactcaccatctccagagaccaacgaccaaagaactacactgtaatctagacaaatagaacagcctagagacgacggagacgacggctgtgtattactgtcgcgagagagcttagtactcgtacggaaccccgtagtacgtttcg

SEQ ID NO: 344607 - DNA, 558 bp, Homo sapiens
  misc_feature: GZ8MTXP02IIROO.11.27.C05.1.454.CMB.2.raw
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (433)..(433): a, c, t, g, unknown or other
  misc_feature (433)..(433): n is a, c, g, or t
tcagcgagagataccacgaccggtgctcgatttagacgcgatcgaagggtttggggagagaggagccttagccctggattccaaggcctatccacttggtgatcagcactgagcaccgaggattcaccatggaactggggctccgctggggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgcaggctccagggaaggggctggagtggggtctcatccattagtagtaaatagtgcctacagatactacgcagactcactgaaggggcgactcaccanctccagagacaacncccaaagaataccactgtaactntacgacaaatacggaacacaccgtcgaagacggaccgacgggacgaacggcgttctggttaattactggtagtcgacggaggaagtaacgtacttaacgttctacggaccccgacgtttacgtcg

SEQ ID NO: 344608 - DNA, 549 bp, Homo sapiens
  misc_feature: GZ8MTXP02J153I.11.27.C05.1.454.CMB.2.raw
  modified_base (359)..(359): a, c, t, g, unknown or other
  misc_feature (359)..(359): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaggggctggagtgggtctcatccattagtagtaatagtcgcctanagatactacgcagactcactagaacgggccgactccaacctatcctcccaagacgaaccaacgaccaaagtaactcactgtactctgacaaatgaacagccagagacggccgaaggaccacgggctggtagtattacgtgtgcgaaggaggagcttaatactccgttacggaacccctatttacctttag

SEQ ID NO: 344609 - DNA, 543 bp, Homo sapiens
  misc_feature: GZ8MTXP02H0YAE.11.27.C05.1.454.CMB.2.raw
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccgagggaaggggctggagtggggtctcatccattagtagtaatagtgcctacagatactacgcngactcactgaagccgactcaccatctccagacgacaacgaccaaagaacctacactagtatacctagacaaaatgaaacagacctagagagccgaaggaccacggctagtgttatactggtcgacgagacggagtctagttaactcgtacggaacccccgattcgtttaccg

SEQ ID NO: 344610 - DNA, 519 bp, Homo sapiens
  misc_feature: GZ8MTXP02FXNBG.11.27.C05.1.454.CMB.2.raw
  modified_base (299)..(299): a, c, t, g, unknown or other
  misc_feature (299)..(299): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccagggaaggggctggagtgggtctcgatccattagtagtaatagtgcctacagatactacgcagactcactgaagggccactcaccatctcagagacaacgccaaagactcactgtatctgacaaatgaaacagcctagagagccgagacacggctagtgtattacgtgtgcgagaggagctaattactctacggaacccgtatcggtttac

SEQ ID NO: 344611 - DNA, 512 bp, Homo sapiens
  misc_feature: GZ8MTXP02JMRCU.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtggggtctcatccattagtagtaatagtgcctacagatactacgcagactcactgaagggccgactcaccatctccagagacaacgccaagaactcactgtatctgacaaatgaacagcctgagagccgaggacacggctgtgtatactgtgcgagagagctattactctaggaaccccgatcgttc

SEQ ID NO: 344612 - DNA, 534 bp, Homo sapiens
  misc_feature: GZ8MTXP02JQ6MR.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtgggtctcatccattagtagtaatagtgcctacagatactacgcagactcactgaagggccgactcaccatctcccagagaacaacgaccaagaactcactagtatctgacaaatagaaacagcctcgagacggaccgaggacgacggtcgtgtcgtagttactgtcgcgagaggagaacgtacttatctacgacccgtacgtagttcg

SEQ ID NO: 344613 - DNA, 556 bp, Homo sapiens
  misc_feature: GZ8MTXP02FWSJ3.11.27.C05.1.454.CMB.2.raw
  modified_base (465)..(465): a, c, t, g, unknown or other
  misc_feature (465)..(465): n is a, c, g, or t
  modified_base (547)..(547): a, c, t, g, unknown or other
  misc_feature (547)..(547): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccgaggctcgagggagggcgtggaggtgggtctcgactcctattagtagtaaatagtcgacctacgagactactacgcagactcacgtagaacgggccgactcaacctatccctccaagacgaaccaaacgccaaagaacctcactgtatctgacaaatcgaaacngcctagagacgccgagacacggctgtagtaattcgtggtcgcgaaggaggtagtcttaagttactcgtaccggaaacccgtntcgtttacg

SEQ ID NO: 344614 - DNA, 528 bp, Homo sapiens
  misc_feature: GZ8MTXP02JJZH4.11.27.C05.1.454.CMB.2.raw
  modified_base (452)..(452): a, c, t, g, unknown or other
  misc_feature (452)..(452): n is a, c, g, or t
  modified_base (496)..(496): a, c, t, g, unknown or other
  misc_feature (496)..(496): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgaggggaaggggctggagtgggtctcatccattagtagtaaatagtgcctacagatactacgcagactcactgaaggggccactcaccatctccagagacaacgccaaagaactcactgtaatctagacaaatgaaacagccngagagccgagacacgctagtgtattacgtgtggacgaggaggancgtattacgtcgtacggaaccccatcgtttcg

SEQ ID NO: 344615 - DNA, 518 bp, Homo sapiens
  misc_feature: GZ8MTXP02IPC97.11.27.C05.1.454.CMB.2.raw
  modified_base (468)..(468): a, c, t, g, unknown or other
  misc_feature (468)..(468): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtgggtctcatccattagtagtaatagtgcctacagatactacgcagactcactgaagggccgactcaccatctcagagacaacgccaaagaactcactgtatctgacaaatgaacagcctagagagccgaggacgacgctgtntattactgtgacgagagagaactattactctacggaaccccgatcgttcg

SEQ ID NO: 344616 - DNA, 537 bp, Homo sapiens
  misc_feature: GZ8MTXP02JUAF2.11.27.C05.1.454.CMB.2.raw
  modified_base (488)..(488): a, c, t, g, unknown or other
  misc_feature (488)..(488): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtggggtctcatccattagtagtaatagtcgcctacagatactacgcagactcactgaagggccgactcaccatctacccagacgacaacgccaaagaacctcacctgtaatctagacaaaatgaacagcctagagagccgaggacacggctgtagtattacgngtacgcgagaggagctaagttactcgtacggaaccccgtatcggtttac

SEQ ID NO: 344617 - DNA, 563 bp, Homo sapiens
  misc_feature: GZ8MTXP02JEHUZ.11.27.C05.1.454.CMB.2.raw
  modified_base (362)..(362): a, c, t, g, unknown or other
  misc_feature (362)..(362): n is a, c, g, or t
  modified_base (553)..(553): a, c, t, g, unknown or other
  misc_feature (553)..(553): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccgccaggctccgagggaaggggctggagtgggtctcatccattagtagtaatagtcgcctanagatactacgcagactcactgaacgggccgactcaccatctccagacgacaacgccaaagaacctcactgtatctagactaaagtgaaacacgccctaggaagtacggaccggaggaaccgacggcttggtagttattacgtggtcgacgtaaggaggacgcttaattacgtaccgtacggaaaccccgtnttacgtttcg

SEQ ID NO: 344618 - DNA, 541 bp, Homo sapiens
  misc_feature: GZ8MTXP02IY3XV.11.27.C05.1.454.CMB.2.raw
  modified_base (531)..(531): a, c, t, g, unknown or other
  misc_feature (531)..(531): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaaggggctggagtgggtctcatccattagtagtaaatagtcgacctacagatactacgcagactcactagaacgggccgactcaccatcctcagacacaacgccaaagaactcactgtatctagacaaatagaacagcctagagacgaccgaggacgacggctgtacgtatactgtacgcgagaggatcgtaattactacgtacggaaaccccgtntacggtttac

SEQ ID NO: 344619 - DNA, 542 bp, Homo sapiens
  misc_feature: GZ8MTXP02JK53T.11.27.C05.1.454.CMB.2.raw
  modified_base (299)..(299): a, c, t, g, unknown or other
  misc_feature (299)..(299): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccgagggaaggggctggagtgggtctcgatccattagtagtaatagtcgcctacagatactacgcagactcactgaagggccgactcaccatcctaccagagacaaacgcccaaagaacctcaactgtaactctagacaaaatgaaacagcctagagacgccgagacgacgctgtagtattactgtgcgagaggagtcgtaattacgtaccgtacggaaccccgtagtcgtttacg

SEQ ID NO: 344620 - DNA, 513 bp, Homo sapiens
  misc_feature: GZ8MTXP02FUDCJ.11.27.C05.1.454.CMB.2.raw
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (495)..(495): a, c, t, g, unknown or other
  misc_feature (495)..(495): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtggggtctcatccattagtagtaatagtgcctacagatactacgcagactcactgaagggcgactcacntctcaganacaacgccaaagaactcactgtaatctgacaaaatgaaacagcctgagagccgagacacggctgtgtattacgtgtgcgagaggagcgtattanctaggaacccgatcgttc

SEQ ID NO: 344621 - DNA, 527 bp, Homo sapiens
  misc_feature: GZ8MTXP02J0U3M.11.27.C05.1.454.CMB.2.raw
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (475)..(475): a, c, t, g, unknown or other
  misc_feature (475)..(475): n is a, c, g, or t
tcagcgagagataccacgaccggtgctcgatttagacgcgatcgaagggtttgggggagagaggagccttagccctggattccaaggcctatccacttggtgatcggcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaagggctggagtgggtctcatccattagtagtaatagtgccctacagatactacgcagctcactgaagggccactcaccatcnccaganacaacgccaaagaactcactgtatctgacaaatgaaacagcctagagagccgaggacacggatgtgtattacngtgcgagacggatctaattacgtcgtacggaaccccgtatcggtcttttagg

SEQ ID NO: 344622 - DNA, 512 bp, Homo sapiens
  misc_feature: GZ8MTXP02IE7TJ.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtgggagtctgggggaggcctggtcaagcctggggggtccctgagactctcctgcgcagcctctggattcaccttcagtagttatagcatgaactgggtccgccaggctccgaggggaaggggctggagtggggtctcgatccattagtagtaatagtgcctacagatactacgcagactcactgaaggggccgactcaccatctccagagacaacgccaaagactcactgtatctgactaaatgaacagcctagagagcgagacacggctgtagtattactgtgcgagagagctatatcagacccgatcgtcg

SEQ ID NO: 344623 - DNA, 519 bp, Homo sapiens
  misc_feature: GZ8MTXP02F8LBV.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccaggggaaggggctggagtggggtctcatccattagtagtaatagtgcctacagatactacgcagactcactgaagggccgactcaccatctccagagacaacgccaaagaactcaactgtaactctagaccaaaatgaaacagacctgagagccgaggacacggctgtgtatactgtgcgagagagctatactctcggaacccgatgttc

SEQ ID NO: 344624 - DNA, 540 bp, Homo sapiens
  misc_feature: GZ8MTXP02G2TXE.11.27.C05.1.454.CMB.2.raw
  modified_base (299)..(299): a, c, t, g, unknown or other
  misc_feature (299)..(299): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcccggggggtccctgagactctcctgcgcagcctctggattcaccttcagtagttatagcatgaactgggtccnccaggcctccgaggggaaggggctgggagtggggtctcgatccattagtagtaatagtgcccctacagatactacgcagctcactggaagggccactcaccatcctaccagacgacaacgccaaagaactcatgaatctgacaaatgaaactgcctagagacgaccgaggacacgggctggtatacttatgtgacggagaggagctaagttactcgtacggacccctatcggtcttttagg

SEQ ID NO: 344625 - DNA, 522 bp, Homo sapiens
  misc_feature: GZ8MTXP02J3HAA.11.27.C05.1.454.CMB.2.raw
  modified_base (372)..(372): a, c, t, g, unknown or other
  misc_feature (372)..(372): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggggtccctgagactctccctgcgcagcctctggattcaccttcagtagttatagcatgaactgggtccgccaggctccaggggaaggggctggagtgggtctcatccattagtagtaatagtgcctacagatactacgcngactcactgaaggggccgactcaccatctccagagacaaacgccaagaactcactgtatcttgcaaatgaaacagccctgagagccggaggacgacggctgtgtattactgtgcgagaggagctattatctaggacccccgatcggtttc

SEQ ID NO: 344626 - DNA, 536 bp, Homo sapiens
  misc_feature: GZ8MTXP02IN9Y4.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtggggtctcgatccattagtagtaaatagtgcctacagatactacgcagactcactgaacggggccgactcaccatcctcagagacaacgccaaagactcactgtatctgacaaatgaacagcctagagacgaccgaggacgacgctagtgttattacgtgtgcgagaggagcttaattactcgtacggaaccccgtagtcgtttacg

SEQ ID NO: 344627 - DNA, 542 bp, Homo sapiens
  misc_feature: GZ8MTXP02GVIWV.11.27.C05.1.454.CMB.2.raw
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccaggctccgagggaaggggctggagtgggtctcgatccattagtagtaatagtcgcctacagatactacgcagactcactgaagggccgactcaaccatcctaccagacgaacaacgaccaaagaacctcactgtaatctgacaaatgaaacagcctagagacgccgaggacacggctgtgtattacngtcgacgagaggagaacgttaattactacgtacggaacccgtagtcgtttacg

SEQ ID NO: 344628 - DNA, 532 bp, Homo sapiens
  misc_feature: GZ8MTXP02IGCS8.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtctgggggaggcctggtcaagcctggggggtccctgagactctcctgcgcagcctctggattcaccttcagtagttatagcatgaactgggtccgccaggctccgagggaggggctggagtggggtctcatccattagtagtaatagtgacctacagatactacgcagactcacgtgaacggggccgactcacccatcctccagagacaacgaccaaagaactacactgtactctagacaaatagaacacgcctagagagccgaggacacgctgtgtattactgtgcgagaggagcgttattatcgtacggaccccgtatcgttacg

SEQ ID NO: 344629 - DNA, 541 bp, Homo sapiens
  misc_feature: GZ8MTXP02HVWEV.11.27.C05.1.454.CMB.2.raw
  modified_base (532)..(532): a, c, t, g, unknown or other
  misc_feature (532)..(532): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagccgtggggggtccctgagactctcctgcgcagcctctggattcaccttcagtagttatagcatgaactgggtccgccaggctccgaggggaaggggctgggagtggggtctcatccattagtagtaatagtgcctacagatactacgcagactcactgaagggccactcaccatctccagacgacaacgcccaaagaacctcactgtaatctagacaaaatgaaacagcctaggagagccggaggacgtacggctagtgtattactgtgcgaggtaggagcttaattactcgtacgggaaaccccnttcgtttcg

SEQ ID NO: 344630 - DNA, 541 bp, Homo sapiens
  misc_feature: GZ8MTXP02GQ1D0.11.27.C05.1.454.CMB.2.raw
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgagggaaggggctggagtggggtctcatccattagtagtaatagtgcctanagatactacgcagactcactgaagggccgactcaccatccnccaganacaacgccaaagaactcacctgtactctgacaaaatcgaaacagaccctagagacgaccggaggacacggctggtagtattacgtgtgacgagaggagtctatttactcgtacggaaccccgtagtcgtttacg

SEQ ID NO: 344631 - DNA, 521 bp, Homo sapiens
  misc_feature: GZ8MTXP02GG31A.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccgccaggctccaggggaaggggctggagtggggtctcatccattagtagtaaatagtgcctacagatactacgcagactcactgaagggccgactcaccatctccagagacaacgccaaagaactcactgtatctagacaaatagaacagaccctgagacgacgaggacgacggctgtgtattactgtgcgagaggagctatactctacggacccgatcgttcg

SEQ ID NO: 344632 - DNA, 522 bp, Homo sapiens
  misc_feature: GZ8MTXP02GDTJH.11.27.C05.1.454.CMB.2.raw
  modified_base (435)..(435): a, c, t, g, unknown or other
  misc_feature (435)..(435): n is a, c, g, or t
  modified_base (488)..(488): a, c, t, g, unknown or other
  misc_feature (488)..(488): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggcctggggggtccctgagactctcctgcgcagcctctggattcaccttcagtagttatagcatgaactgggtccgccaggctccgagggaaggggctggagtgggtctcatccattagtagtaatagtcgcctacagatactacgcagactcactgacgggggccgactcaccatcctccagagacaacgccaaagactcactgtatcngacaaatgaacagcctgagacgcgaggacacggctgtgtattactgtgcgagnggagctatactcgtacggacccgtatcgtttacg

SEQ ID NO: 344633 - DNA, 509 bp, Homo sapiens
  misc_feature: GZ8MTXP02GFWQO.11.27.C05.1.454.CMB.2.raw
  modified_base (492)..(492): a, c, t, g, unknown or other
  misc_feature (492)..(492): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtggggtctcgatccattagtagtaatagtgcctacagatactacgcagactcactgaagggcgactcaccatctccagagacaacgccaagaactcactgtatctgcaaatgaacagcctagacgagcgaggacacggctgtgtattactgtgcgagagagctatanctacgacccgatgttcg

SEQ ID NO: 344634 - DNA, 528 bp, Homo sapiens
  misc_feature: GZ8MTXP02G9LOS.11.27.C05.1.454.CMB.2.raw
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgaggggaaggggctggagtgggtctcatccattagtagtaatagtcgcctacagatactacgcagactcactgaagggccgactcaccatcctaccagagacaacgaccaagaactcactgtatctagacaaatgaacagcctgagacgcgaggacacggctgtntatactgtcgcgagaggancgtattactacgtacgaaccccgtagtcgtttacg

SEQ ID NO: 344635 - DNA, 580 bp, Homo sapiens
  misc_feature: GZ8MTXP02FRKEJ.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcatccattagtagtaaatagtgcctacagatactacgcagactcactgaacgggccgactcaccatccctaccagacgacaacgccaaagaactcactgtaatctagacaaaatcgaaacagaccctaggacgacgacccggaaggaacctacggggacttcggtagttaactttacgtggtagacggaaggaggagtaacctttaagttacgtcgtaccgggaaaccccgtagttcgttttacg

SEQ ID NO: 344636 - DNA, 523 bp, Homo sapiens
  misc_feature: GZ8MTXP02G2EJC.11.27.C05.1.454.CMB.2.raw
  modified_base (479)..(479): a, c, t, g, unknown or other
  misc_feature (479)..(479): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtggggtctcatccattagtagtaatagtgcctacagatactacgcagactcactgaagggccgactcaccatctccagagacaaacgccaagaactcactgtatctgacaaatgaacagcctagagagccgaggacacggctgtgtattacgngtgcgagaggagctattactcgtacggaaccccgatcgtttacg

SEQ ID NO: 344637 - DNA, 529 bp, Homo sapiens
  misc_feature: GZ8MTXP02JAFPD.11.27.C05.1.454.CMB.2.raw
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (501)..(501): a, c, t, g, unknown or other
  misc_feature (501)..(501): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccncaggctccgagggaggggctggagtggggtctcgatccattagtagtaaatagtcgacctacagatactacgcagactcactagaacgggccgactcaccatcnccaganacaacgccaaagaactcactgtaatctagacaaatgaacacgcctaggagacgaccgaggacacggctgtagtattacgtgtgcgagagganctattactcacggaacccgtatcgttcg

SEQ ID NO: 344638 - DNA, 573 bp, Homo sapiens
  misc_feature: GZ8MTXP02HTVTV.11.27.C05.1.454.CMB.2.raw
  modified_base (400)..(400): a, c, t, g, unknown or other
  misc_feature (400)..(400): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggggtggtctcatccattagtagtaatagtcgccctacagatactacgcagctcactgaacgggccgactcaccatcnccagaacgacaacgaccaaagaactcactgtatctgacaaaatgaaacagccctagaacgacgacccggaaggaccacgggactggtagttaactttacgtggtcggacggaaggacggaacgacttaagttacgtaccgttacgggaaaccccgtatcggtttctttttagg

SEQ ID NO: 344639 - DNA, 566 bp, Homo sapiens
  misc_feature: GZ8MTXP02HW2Y9.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaacgtgggtccgccaggcctccgaggggaaggggctggagtgggtctcgatccattagtagtaatagtcgcctacagatactacgcagactcacgtagaacggcccgactcacccatcctaccagacgaccaaacgaccaaagaacctcactagtatctagacaaatgaaacagccgtagacgacgaccggaagaccacggctgtacgttattactggtagacggagaaggacgaacgttaattacgtcgtacggaaccccgtagttcgtttacg

SEQ ID NO: 344640 - DNA, 600 bp, Homo sapiens
  misc_feature: GZ8MTXP02I3QOG.11.27.C05.1.454.CMB.2.raw
  modified_base (416)..(416): a, c, t, g, unknown or other
  misc_feature (416)..(416): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagttatagcatgaactgggtccgccaggctccgaggggaaggggctggagtgggtctcatccattagtagtaatagtcgcctacagatactacgcagactacactagaacgggccgactcaacccatcctcccgaaganaacccaaacgcccaaaagaacctcactgtaactctagaacaaaatcgaaaaccagccctaggaacgacggacccgaagggaaccctacgggccttaggttacgttaaattaccgtggtacgacggaacgaagggtactaacgttaatttacgtaccgtacgggaaaaccccctgttcgtttacg

SEQ ID NO: 344641 - DNA, 538 bp, Homo sapiens
  misc_feature: GZ8MTXP02F5QYK.11.27.C05.1.454.CMB.2.raw
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgagggaaggggctggagtggggtctcatccattagtagtaatagtgcctacagatactacgcngactcactgaagggccgactcaccatcncaganacacgccaagaactcactgtactctagacaaatgaaacagaccctgagagaccgagggaccacgggcttggtagttagttactggtgcgaagaggagcttaattatccgtacggaaccccgtatcggtttacg

SEQ ID NO: 344642 - DNA, 537 bp, Homo sapiens
  misc_feature: GZ8MTXP02FQVWH.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtggggtctcatccattagtagtaatagtgcctacagatactacgcagactcactgaaacgggccgactccaccatcctccagacgacaaacgcccaaagaactcaactgtatctgacaaatgaaacagcctgagacgaccgagacacgggctgtagtattacgtgtcgcgagaggagcgtattactcgtacggaacccgatcgtttacg

SEQ ID NO: 344643 - DNA, 589 bp, Homo sapiens
  misc_feature: GZ8MTXP02G87Y1.11.27.C05.1.454.CMB.2.raw
  modified_base (364)..(364): a, c, t, g, unknown or other
  misc_feature (364)..(364): n is a, c, g, or t
  modified_base (558)..(558): a, c, t, g, unknown or other
  misc_feature (558)..(558): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccaggctccgaggggaaggggctggagtgggtctcatccattagtagtaatagtcgacctanagatactacgcagctacacgtagaacgggggacccactaccaaccctatccctacccaaggaccgaacaaccgacccaaacgaacctcaacctgtaatccttagaactaaaagtacgaaacgacgaccctaggaacgacggacccggaaggaccgaacgcttggtacgtatttacgtgtagacggagaggagtnttaactatacgacggaaccccgtatcgtttc

SEQ ID NO: 344644 - DNA, 535 bp, Homo sapiens
  misc_feature: GZ8MTXP02JO06P.11.27.C05.1.454.CMB.2.raw
  modified_base (437)..(437): a, c, t, g, unknown or other
  misc_feature (437)..(437): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgggagactctcctgcgcagcctctggattcacccttcagtagttatagcatgaactgggtccgccaggctccgaggggaaggggctggagtggggtctcatccattagtagtaatagtgcctacagatactacgcagactcactgaagggccactcaccatcctccagacgacaaacgccaaagaactcactgtanctagacaaatgaacagcctgacgagccgaggacacgggctgtgtattactgtagcgagaggagaacgtattacgtctacggaaccccagtcgtttacg

SEQ ID NO: 344645 - DNA, 549 bp, Homo sapiens
  misc_feature: GZ8MTXP02F90CU.11.27.C05.1.454.CMB.2.raw
  modified_base (301)..(301): a, c, t, g, unknown or other
  misc_feature (301)..(301): n is a, c, g, or t
  modified_base (416)..(416): a, c, t, g, unknown or other
  misc_feature (416)..(416): n is a, c, g, or t
  modified_base (543)..(543): a, c, t, g, unknown or other
  misc_feature (543)..(543): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgagggaaggggctggagtgggtctcatccattagtagtaatagtcgacctacagactactacgcagactcacgtggaacgggcccgactcacccatcctaccaganaaccaacgcccaaagaactcactgtaatatagacaaatgaaacagaccctagagagaccgaggacacggctgtgtattactggtcgacggagaggagaacttattacgtacgtacggaaaccccgtnttcgtc

SEQ ID NO: 344646 - DNA, 535 bp, Homo sapiens
  misc_feature: GZ8MTXP02HQUQR.11.27.C05.1.454.CMB.2.raw
  modified_base (514)..(514): a, c, t, g, unknown or other
  misc_feature (514)..(514): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagtagttatagcatgaactgggtccgccaggctccgaggggaagggctggagtgggtctcatccattagtagtaatagtcgacctacagtatactacgcagactcactgaacgggccgactcaccatctacagagacaacgaccaaagaactcactgtatctgacaaagtagaacagcctagagacgcgaacggacaacggctcgtagttatacgtgtcgacgagaggagaactattacncgtacgaccccgattcgttcg

SEQ ID NO: 344647 - DNA, 521 bp, Homo sapiens
  misc_feature: GZ8MTXP02IFBQ0.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgcgcagcctctggattcaccttcagtagttatagcatgaactggggtccgccaggctccaggggaaggggctggagtggggtctcatccattagtagtaatagtgcctacagatactacgcagactcactgaaggggccgactcaccatctccagagacaacgccaaagaactcactgtatctgacaaatgaacagcctgagagccgaggacacgctgtgtattactgtcgcgagaggagctattactctacggaccccgtatcgttacg

SEQ ID NO: 344648 - DNA, 516 bp, Homo sapiens
  misc_feature: GZ8MTXP02F5ZBT.11.27.C05.1.454.CMB.2.raw
  modified_base (299)..(299): a, c, t, g, unknown or other
  misc_feature (299)..(299): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
  modified_base (509)..(509): a, c, t, g, unknown or other
  misc_feature (509)..(509): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccncaggctccagggaggggctggagtgggtctcatccattagtagtaatagtgcctacagatactacgcngactcactgaagggccgactcaccatctccagagacaacgccaagaactcacngtatctagcaaatgaaacagaccctgagagaccgaggaacacggctgtgtatactgtgcgagaggagctatactactggaaaccccgtntcgttcg

SEQ ID NO: 344649 - DNA, 516 bp, Homo sapiens
  misc_feature: GZ8MTXP02JCRHT.11.27.C05.1.454.CMB.2.raw
  modified_base (484)..(484): a, c, t, g, unknown or other
  misc_feature (484)..(484): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtggggtctcatccattagtagtaatagtgcctacagatactacgcagactcactgaagggccgactcaccatctccagagacaacgccaaagaactcactgtatctgcaaatgaacagcctgagagccgaggacacggctggtgtattactgtgcgagnggagctattatctcggaaccccgatcgtttac

SEQ ID NO: 344650 - DNA, 535 bp, Homo sapiens
  misc_feature: GZ8MTXP02JI0M8.11.27.C05.1.454.CMB.2.raw
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccgagggaaggggctggagtgggtctcatccattagtagtaaatagtgcctacagaatactacgcagactcactgaaagggccgaactcaaccatcnccagagacaaacgccaaaagtaacncactntaatctagacaaataanaacanacagagacgacgacgacgacgacgtcgtagtatactagtagacgagagagaagtatactacgtacgaccgacgtacgtcg

SEQ ID NO: 344651 - DNA, 558 bp, Homo sapiens
  misc_feature: GZ8MTXP02JV33N.11.27.C05.1.454.CMB.2.raw
  modified_base (373)..(373): a, c, t, g, unknown or other
  misc_feature (373)..(373): n is a, c, g, or t
  modified_base (518)..(518): a, c, t, g, unknown or other
  misc_feature (518)..(518): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaaggggctggagtggggtctcatccattagtagtaatagtgcctacagatactacgcngactcactgaagggccgactcaccatctcccagagaccaacgcctaaagaactcactgtaatcctagacaaatagaaacagcctagaggacgcccggaaggaccgacgggctcggtagttattaacgtggtcgcggaagagggancgttaattacgtcgttacggaaacccccgtagtcgtttcg

SEQ ID NO: 344652 - DNA, 623 bp, Homo sapiens
  misc_feature: GZ8MTXP02I9177.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccaggctccgaggggaaggggctggagtgggtctcatccattagtagtaatgtcgcctacagatactacgcagactcacgtgaacgggccgactccaaccatcctacccgagacgaaccaaacgcccaaagaacctcactgtactctagaacaaagtacgaaacacgcctaggaacgacggacccggaagggtaaccgacgggtcttaggtacgttaaacgttaccgtggttaggaccgggaaaggacgggaacgtccgtttaaagttaacgttaccggtaacccggggtaaaaccccccgtagtttacggttttaaccgg

SEQ ID NO: 344653 - DNA, 625 bp, Homo sapiens
  misc_feature: GZ8MTXP02JR0GL.11.27.C05.1.454.CMB.2.raw
  modified_base (467)..(467): a, c, t, g, unknown or other
  misc_feature (467)..(467): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaaggccgtggggggtccctgagactctcctgcgcagcctctggattcaccttcagtagttatagcatgaacgtgggtccgccgaggctccgaggggaaggggctggaggtgggtctcatccattagtagtaatagtcgacctacagatactacgcagactcactagaacgggccgactaccaacctatccctaccagaacgaacccaaaccggacccaaaagaaccctacaacttcgttaacncttacgaaccaaaatacgaaacccagccctaagaggacgccgggaaggtaaccgacgggtcttaggtacggttaaacttacggttgacggaccgggtaaggaaggggtactcgtaagtttacgtaccggtaccggtaaccccgtagttcggttttacg

SEQ ID NO: 344654 - DNA, 524 bp, Homo sapiens
  misc_feature: GZ8MTXP02IYD4S.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtggggtctcatccattagtagtaaatagtgcctacagatactacgcagactcactagaagggccactcaccatctccagagacaacgccaaagaactcactgtatctgacaaatagaacagcctagagacgcgaggacacggctgtgtatactgtgcgagaggagctattacgtcgtacggaaccccgagtcgtttacg

SEQ ID NO: 344655 - DNA, 546 bp, Homo sapiens
  misc_feature: GZ8MTXP02GD7M1.11.27.C05.1.454.CMB.2.raw
tcagcgagagataccacgaccggtgctcgatttagacgcgatcgaagggtttgggggagagaggagccttagccctggattccgaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgaggggaaggggctggagtgggtctcgatccattagtagtaaatagtcgcctacagatactacgcagactcactgaagggccactcaaccatctccagagaacaacgccaaagaactcactgtaatctagacaaatgaaacagaccctgaacgacggcccgaggacctacggctgtagtattactgtacgcgaagaggagaacttattactacgtacggaaccccgtatcgtttacg

SEQ ID NO: 344656 - DNA, 522 bp, Homo sapiens
  misc_feature: GZ8MTXP02HRLMA.11.27.C05.1.454.CMB.2.raw
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtggggtctcatccattagtagtaatagtgcctanagatactacgnagactcactgaagggccgatcaccatctcaganacaacgccaaagaactcactgtatctgacaaatgaacagccctagagagccgaggacacggctgtagttatactgtgcgagaggagctattactcgtacggaaccccgtatcgtttcg

SEQ ID NO: 344657 - DNA, 591 bp, Homo sapiens
  misc_feature: GZ8MTXP02FSP28.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgcaggctccgaggggaggggctggagtgggtctcatccattagtagtaaatagtcgcctacagatactacgcagactcactggaaacggggccgaactccaaccatcctccaagaacgaacaaaccgaccaaagaacctacaactgtaatctacgacaaatagaaactagaccctaggacggacggaccggaacggaaccgacgggtacgtcggttaggttatttacgtggtacggacgaggagggagtaacgttaattacgtacgtacggaaccccgtagttcgtttacg

SEQ ID NO: 344658 - DNA, 522 bp, Homo sapiens
  misc_feature: GZ8MTXP02JNWLA.11.27.C05.1.454.CMB.2.raw
  modified_base (411)..(411): a, c, t, g, unknown or other
  misc_feature (411)..(411): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccagggaaggggctggagtggggtctcatccattagtagtaatagtgcctacagatactacgcagactcactgaagggccgactcaccatcctccagagacaacnccaaagaactcactgtatctagcaaatgaacagcctagagagccggaggacacggctagtcgttatactgtcgcgagagagctattactcgtacggaccccgtatcgttcg

SEQ ID NO: 344659 - DNA, 535 bp, Homo sapiens
  misc_feature: GZ8MTXP02JGW8M.11.27.C05.1.454.CMB.2.raw
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
  modified_base (527)..(527): a, c, t, g, unknown or other
  misc_feature (527)..(527): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtcccctgagactctcctgcgcagcctctggattcaccttcagtagttatagcatgaactgggtccgccaggctccgaggggaaggggctggagtggggtctcatccattagtagtaaatagtgcctacagatactacgcagactcactgaagggccgactcaccatcctccagagaacaacgccaaagaacctnactgtaanctgacaaatgaaacagcctagagagccgaggacacggctagtgtattacngtgcgaagaggagctaattagtacgtaggaaacccccgtntacgttcg

SEQ ID NO: 344660 - DNA, 540 bp, Homo sapiens
  misc_feature: GZ8MTXP02HO5DO.11.27.C05.1.454.CMB.2.raw
  modified_base (365)..(365): a, c, t, g, unknown or other
  misc_feature (365)..(365): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactggggtccgccaggcctccgaggggaaggggctgggagtggggtctcatcctattagtagtaatagtcgcctanagatactacgcagactcactgaagggccgactccaccatctcccagacgaacaacgaccaagaactcactagtatctgactaaatcgaaacagcctagagacgcgaggacgacggctgtgtattactgtcgcgagaggagtcgtattacgtcgtacggaaccccgtatcgtttcg

SEQ ID NO: 344661 - DNA, 542 bp, Homo sapiens
  misc_feature: GZ8MTXP02JEA0K.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccgccaggctccgaggggaaggggctggagtggggtcctcatccattagtagtaaatagtcgacctacagatactacgcagactcactgaagggccgaactcaccatcctccagagaccaacgccaaagaactccactgtaatctagaccaaatgaaacagccctagacgacgccggaggacaacgggctagtgtattactgtcgcgagagagctattactcgtcggaaccccagtcgtttacg

SEQ ID NO: 344662 - DNA, 532 bp, Homo sapiens
  misc_feature: GZ8MTXP02JFQDL.11.27.C05.1.454.CMB.2.raw
  modified_base (300)..(300): a, c, t, g, unknown or other
  misc_feature (300)..(300): n is a, c, g, or t
  modified_base (466)..(466): a, c, t, g, unknown or other
  misc_feature (466)..(466): n is a, c, g, or t
  modified_base (526)..(526): a, c, t, g, unknown or other
  misc_feature (526)..(526): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccncaggctccgagggaggggctggagtggggtctcgatccattagtagtaaatagtgcctacagatactacgcagactcactgaacgggccgactcaccatcctccagagacaacgccaaagactcactgtatctgacaaatagaacagacctgagagaccgaggacncggctagtgttatacgtgtcggcgaggaggagctagttactcgtacggaaccccgtagtntttacg

SEQ ID NO: 344663 - DNA, 575 bp, Homo sapiens
  misc_feature: GZ8MTXP02IO5DZ.11.27.C05.1.454.CMB.2.raw
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (404)..(405): a, c, t, g, unknown or other
  misc_feature (404)..(405): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctggtcaagccgtggggggtccctgagactctcctgcgcagcctctggattcaccttcagtagttatgcatgaactgggtccnccaggctccgaggggaaggggcgtggagtggggtctcgatccattagtagtaaatagtgaccctanagatactacgcngactcagtgaacggggcactcaccnncctccagagacaacgccaaagactacactgtatcctagacaaatacgaacacgaccagaacgacggacccggaggtaccgacggccgttaggtagttaagttcgttaggtgcggaaaggaggacgtaagtttaacgttacttaccgtacggacccccgtagtcgttttag

SEQ ID NO: 344664 - DNA, 565 bp, Homo sapiens
  misc_feature: GZ8MTXP02HCEC3.11.27.C05.1.454.CMB.2.raw
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccgccaggcctccgaggggaggggcgtggagtgggtctcatccattagtagtaatagtcgcctacagatactacgcagactcactagaagggcccgactccaccatcctccaganaccaacgccaaagaacctcactgtaanctagacaaatcgaaacagcctagacgacgccggaggaccacggcttggtagtattacgtggtcggacgaggtagggaacgtcttaagttacgtaccgtacgggaaaccccgtagtcgtttaccg

SEQ ID NO: 344665 - DNA, 594 bp, Homo sapiens
  misc_feature: GZ8MTXP02HD2NK.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccgccaggctccgaggggaacggggctgggagtggggtctcgatccattagtagtaatagtcgcctacagatactacgcagactcactgaaggggccgactccaccatcctccagagaacacgaccaaagaactcacgtgtaatctagactaaatacgaaacagaccctagaagacggccggaagggaccaacgggccttaggtacgttaagtttaaccgtggtacggccgaacggagggaaggtaacgttaatttaacgtccgttacgggaaacccccgtaagttcggtttaccg

SEQ ID NO: 344666 - DNA, 612 bp, Homo sapiens
  misc_feature: GZ8MTXP02JXMXD.11.27.C05.1.454.CMB.2.raw
  modified_base (389)..(389): a, c, t, g, unknown or other
  misc_feature (389)..(389): n is a, c, g, or t
  modified_base (549)..(549): a, c, t, g, unknown or other
  misc_feature (549)..(549): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtgggggtccctgacgactctcctgcgcacgcctcgtggattccaccttcagtagttatagcatcgaacgtcgggtccgccgaggcctccggaggggacggggcgtaggaggtcgggtctcgtacttacctaattagtagtaaattaggtccgacctaanacgtaatacctacgcacgacctacacgtaggaacgggccgactaccaacctactcctacgaagacgaaacccaacgacccaaagaactcgtactacgtatctagactaaagcgaacgagcctaggagacgcgtaggacgacgcttagtacgtacttacgnggtacgacgaggacgtagtaacttaacgttactaccggtaccggaaaccttgtaccgttttag

SEQ ID NO: 344667 - DNA, 529 bp, Homo sapiens
  misc_feature: GZ8MTXP02G2AM0.11.27.C05.1.454.CMB.2.raw
  modified_base (495)..(495): a, c, t, g, unknown or other
  misc_feature (495)..(495): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtggggtctcatccattagtagtaatagtcgcctacagatactacgcagactcactgaagggccgactcaccatcctccagagaacaacgccaaagactcactgtatctgacaaatgaacagcctgagagaccgagacacggctgtagtaattctggtacgcgagaggancttaattactcgtacggaacccgtatcgtttacg

SEQ ID NO: 344668 - DNA, 523 bp, Homo sapiens
  misc_feature: GZ8MTXP02FJHYQ.11.27.C05.1.454.CMB.2.raw
  modified_base (372)..(372): a, c, t, g, unknown or other
  misc_feature (372)..(372): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtggggtctcatccattagtagtaaatagtgcctacagatactacgcngactcactgaagggccgactcaccatcctccagagacaacgccaaagaactcactgtatctgacaaatgaaacagccctagagagccgaggacacggctgtgtattctgtgcgagaggagctaattactctacggaaccccgatcgttacg

SEQ ID NO: 344669 - DNA, 577 bp, Homo sapiens
  misc_feature: GZ8MTXP02GL1BM.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagttatagcatgaacgtgggtccgccgaggcctccgaggggaaggggcgtggaggtgggtctcatcctaattagtaagtaaatagtcgacctacagtatactacgcacgactacacgtacggaacgggcccgactccaaccatcctacaagacaaccaaaccgaccaaacgactacactagtactcgtagaacaaatacgaacacgcctagagacgacgagacgacgcttagtattatacgtgtcggacgaagagggataacgttaattacgtaccgacgtaaccccgtattcgtttacg

SEQ ID NO: 344670 - DNA, 627 bp, Homo sapiens
  misc_feature: GZ8MTXP02I0FNU.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaggggctggaggtgggtctcatccattagtagtaatagtgcctacagatactacgcagactcacgtagaacggggcccgactcaacccatcctaccagagacaaacgccaaagaacctcaactgtaactctagactaaaatcgaaactatccctaggaagacggacccggaagggaacctaacggggcttacggttgttaaacttaccgttagggtacggacggaaagggaacggggtaagtaacccgtttaaatttaaaccgttccgggtaaacccgggtaaacccccgtaagtttacggtttttaccgg

SEQ ID NO: 344671 - DNA, 649 bp, Homo sapiens
  misc_feature: GZ8MTXP02G5ZD5.11.27.C05.1.454.CMB.2.raw
  modified_base (302)..(302): a, c, t, g, unknown or other
  misc_feature (302)..(302): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaaggtgtccagtgtgaggtgcagctggtggagtcgtgggggaggcctggtcaaggccgtggggggtccctgagactctcctgcgcagcctctggattcaccttcagtagttatagcatgaacgtgggtccnccgaggcctccggaggggaaggggcgtggaggtgggtctcatcctattagtagtaatagtcgacctacagactactacgcagactcacgtaggaacgggccactaccaccatccctacaggaacaaccaaccgaccaaagtaacctacaacttgtaacttcgtagaacctaaaagtacgaaacgacgcccgtaggaaacggacggaccgggaacggaaccgacgggtactttagggttacgtttaaacgtttccgtagggtacggaaccgggtaaaggacgggtaacgtaacgtttaaagttacggttaccgtaagggtaaaccccttcccgggttaattttccggg

SEQ ID NO: 344672 - DNA, 562 bp, Homo sapiens
  misc_feature: GZ8MTXP02GQWUL.11.27.C05.1.454.CMB.2.raw
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcgatcctattagtagtaatagtcgcctacagatactacgcagacctcactaggaacgggcccgactccaccatcctaccagacgacaaacgaccaaagaacctcactgtaatctagacaaatgaaacagcctagacgacgccggaggaccacggtctgtagtattacgtggtgacgaggaaggngaacgttaattacgtacgtacggaaccccgtagttacgtttcg

SEQ ID NO: 344673 - DNA, 574 bp, Homo sapiens
  misc_feature: GZ8MTXP02I33RX.11.27.C05.1.454.CMB.2.raw
  modified_base (301)..(301): a, c, t, g, unknown or other
  misc_feature (301)..(301): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggaaggggctggaggtgggtctcatccatttagtagtaaatagtcgacctacagatactacgcagactcactgaacgggccgactcaaccatctaccagacacaacgccaaagaactcactgtaactctagacaaaatcgaaacacgacctaggaacgacgacccggaggtaaccgacgtcgtcggttagtaattaccgtgtacggacgaggaggaagcttaagttacgtccgttacggaaaccccgtagttacgtttcg

SEQ ID NO: 344674 - DNA, 550 bp, Homo sapiens
  misc_feature: GZ8MTXP02GCHFB.11.27.C05.1.454.CMB.2.raw
  modified_base (299)..(299): a, c, t, g, unknown or other
  misc_feature (299)..(299): n is a, c, g, or t
  modified_base (490)..(490): a, c, t, g, unknown or other
  misc_feature (490)..(490): n is a, c, g, or t
  modified_base (541)..(541): a, c, t, g, unknown or other
  misc_feature (541)..(541): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccgaggggaggggctggagtgggtctcatcctattagtagtaaatagtcgcctacagtatactacgcagactcactgaacgggccgactcaccatccaccagacacaaacgcctaaagaacctcactgtaatcctgacaaaatgaaacagacctaggacgaggccgaaggacgacgggctggtntaatacgtggcgtacgaaggaggtagcttagttactcgtacggaaaccctntacggtttc

SEQ ID NO: 344675 - DNA, 543 bp, Homo sapiens
  misc_feature: GZ8MTXP02FP96A.11.27.C05.1.454.CMB.2.raw
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgcaggctccgagggaggggctggagtgggtctcgatccattagagtaatagtgcctacagatactacgcagactcactgaacgggccgactcaccatcctccaganaacacgaccaaagactnactgtatctagacaaatgaaactagcctagagacgacgagggacacggtctagtagtattacgtgtaggacggagaggganaacttagttactacgttaccggaaccccgtagtcgtttcg

SEQ ID NO: 344676 - DNA, 538 bp, Homo sapiens
  misc_feature: GZ8MTXP02G7DSM.11.27.C05.1.454.CMB.2.raw
  modified_base (363)..(363): a, c, t, g, unknown or other
  misc_feature (363)..(363): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtggggtctcatccattagtagtaatagtcgcctanagatactacgcagactcactagaacgggccgactcaccatctccagacacaacgccaaagactcactgtatctgacaaatgaaacagcctagacgagaccgaggacacggctgtgtattacgtgtacgcgtagacggagtcttagttactcgtacggaacccctagtcgtttacg

SEQ ID NO: 344677 - DNA, 543 bp, Homo sapiens
  misc_feature: GZ8MTXP02HUPHU.11.27.C05.1.454.CMB.2.raw
  modified_base (301)..(301): a, c, t, g, unknown or other
  misc_feature (301)..(301): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagccgtggggggtccctgagactctcctgcgcagcctctggattcaccttcagtagttatagcatgaactgggtccnccaggctccgagggaaggggctggagtgggtctcatccattagtagtaatagtgcctacagatactacgcagactcactgaaaggccgactcaccanctccaganacaacgaccaaagaacncactgtatctagacaaatgaacagcctagagacgaccggaagacgtacggctggtacgttattactgtgacgaggagagtaacctaattactcgacgggaaacccccagttcgtttaccg

SEQ ID NO: 344678 - DNA, 633 bp, Homo sapiens
  misc_feature: GZ8MTXP02G5U7S.11.27.C05.1.454.CMB.2.raw
  modified_base (363)..(363): a, c, t, g, unknown or other
  misc_feature (363)..(363): n is a, c, g, or t
  modified_base (417)..(417): a, c, t, g, unknown or other
  misc_feature (417)..(417): n is a, c, g, or t
  modified_base (473)..(473): a, c, t, g, unknown or other
  misc_feature (473)..(473): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggaggtgggtctcatccattagtagtaatagtcgcctanagatactacgcagactcacgtgaacgggccgactccaacccatccctccaaganaacaacgacccaaagaacctcactgtaactcctagaacctaaagtacgaaacgacncccgtaggaacgaacggacccggtaagggaaccgtaccggggcttagggttacgttaaacgtttaaccgtcggtggaccggaaacgggtaggggaaacttaaccgttaaatttacgtaccggttaacccgggaaaacccccgttgtttacggttttaccg

SEQ ID NO: 344679 - DNA, 548 bp, Homo sapiens
  misc_feature: GZ8MTXP02JZDAR.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccgccaggctccgagggaggggctggagtgggtctcatccattagtagtaatagtgcctacagatactacgcagactcacgtgaaggggcccgaactccacccatcctaccgaagacgaaccaacgacccaaagaacctcactgtactctgacaaatgacagcctgagacgcgagacacggctggtagtattcgtagtcggacgaggaggagtcttattactcgtaccggaaccccgtagtcgtttacg

SEQ ID NO: 344680 - DNA, 573 bp, Homo sapiens
  misc_feature: GZ8MTXP02H0CR1.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggcctccgaggggaaggggctggagtggggtctcatccattagtagtaatagtgacctacagatactacgcagactcactgaacggggccactccaccatcctaccaagagaaccaaacgcccaaagaactcactgtatctgaacaaatagaaacagaccctaggaacgacggccgaagggaccgacggcttggtagttactttacgtggtcgacggaagtagggagtcttaagttaacgtcgtaccggaaccccgtagttcgtttacg

SEQ ID NO: 344681 - DNA, 568 bp, Homo sapiens
  misc_feature: GZ8MTXP02JVYV4.11.27.C05.1.454.CMB.2.raw
  modified_base (359)..(359): a, c, t, g, unknown or other
  misc_feature (359)..(359): n is a, c, g, or t
  modified_base (450)..(450): a, c, t, g, unknown or other
  misc_feature (450)..(450): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgactgggtccgccaggctccgagggaaggggctggagtgggtctcatccattagtagtaatagtcgcctanagatactacgcagactcacgtgaacgggccgactcaccatcctaccagacgacaacgccaaagacctcactgtatctagacaaatgaaacngaccctggacgacgccgaggaccacggcttacggtgtattacgtggtacggacggtaaggaggacgaacttaacgtttactccggttaaccgggaaaacccccgtgttacggttttcg

SEQ ID NO: 344682 - DNA, 587 bp, Homo sapiens
  misc_feature: GZ8MTXP02IS4S8.11.27.C05.1.454.CMB.2.raw
  modified_base (302)..(302): a, c, t, g, unknown or other
  misc_feature (302)..(302): n is a, c, g, or t
  modified_base (413)..(413): a, c, t, g, unknown or other
  misc_feature (413)..(413): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccnccaggctccgagggaaggggctgggagtggggtctcatccattagtagtaaatagtcgcctacagtatactacgcagactcactgaacgggccgactcaccatcctcaganacaacgccaaagaactcactgtactctagactaaatcgaaaacagaccctaggaacgaacggccggaagggaacccgtacgggccttaggtagtttaattaaccgtggtcgacggtaaggaacggtacgtaacttaagttaactccgtaacgggaacccccgtattcgtttacg

SEQ ID NO: 344683 - DNA, 589 bp, Homo sapiens
  misc_feature: GZ8MTXP02IJNMS.11.27.C05.1.454.CMB.2.raw
  modified_base (363)..(363): a, c, t, g, unknown or other
  misc_feature (363)..(363): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcatccattagtagtaaatagtcgcctanagatactacgcagactacactgaaacgggccgactccaacctatccctaccgaagacgaaaccaacgaccaaagaacctcactagtactctagaactaaatgaaacacgacctagaacggacgcccggaaaggaccaacgggcttggtagttaacttacgtggtacgacggaaggagggactaacgttaattacgtccgtaaccggaaccccgtagttcgtttacg

SEQ ID NO: 344684 - DNA, 569 bp, Homo sapiens
  misc_feature: GZ8MTXP02IHUPO.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggcgtggagtgggtctcatccattagtagtaatagtcgacctacagatactacgcagactcacgtgaacggggccgactccaccatcctaccagacgacaacgccaaagaactacactgtatctagacaaaatgaacagcctgagacggccgaggacacgggctggtagtattacttggtacgacggaagtagggagtaacgtttaattacgttaccgtaaccggtaacccccgtaagttcggtttacg

SEQ ID NO: 344685 - DNA, 576 bp, Homo sapiens
  misc_feature: GZ8MTXP02JVJDT.11.27.C05.1.454.CMB.2.raw
  modified_base (366)..(366): a, c, t, g, unknown or other
  misc_feature (366)..(366): n is a, c, g, or t
  modified_base (451)..(451): a, c, t, g, unknown or other
  misc_feature (451)..(451): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcaccttcagtagttatagcatgaactcgggtccgccaggctccgaggggaaggggcgtggagtcgggtctcgatccattagtagtaatgtcgcctanagactactacgcacgacctcactaggaacgggccgactacacccagttcccaccagacgaacaaccgaccaagaacctacacgtntactctacgacaaatagaacacgacccgtaggagacgccggaggacgacggtctagtagttaattacgtggtacgacgaacggagagtcttaattacgtacgtacggaacccgtagtacgtttcg

SEQ ID NO: 344686 - DNA, 577 bp, Homo sapiens
  misc_feature: GZ8MTXP02IOL0T.11.27.C05.1.454.CMB.2.raw
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcatccattagtagtaaatagtcgcctanagtatactacgcagactcactagacgggtcgactcacntcctcaganacaacgccaaagaacctnactgtatcctagaactaatcgaacaacgccgtagacgacggaccgaggaaccgcggtcttaggtacgtttaagttcgttaggcggacggaaacggaggtacgtaacttaacgttactccggaaccggtaaccccgtattcggttttacg

SEQ ID NO: 344687 - DNA, 587 bp, Homo sapiens
  misc_feature: GZ8MTXP02F9092.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgcgcagcctctggattcaccttcagtagttatagcatgaactgggtccgccaggcctccgaggggaaggggctggagtgggtctcatcctattagtagtaaatgtcgacctacagactactacgcagactcacgtagaacggccgactccaccatcctcaagacgaacaaccgaccaaagaacctcactgtactctagactaaatacgaaactagacccgtagaacgacggacccggaaggaccgaacggcgtagttagttactttacgtggtcgacgaaggacggaagtccgttaagttaacgtaccgtaccggaaccccgtaagttcgttttacg

SEQ ID NO: 344688 - DNA, 604 bp, Homo sapiens
  misc_feature: GZ8MTXP02IJ6RL.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctatttagaaggtgtccagtgtgaggtgcagctggtggagtcgtgggggaggcctggtcaagccgtgggggtccctgagactctcctgcgcagcctctggattcaccttcagtagttatagcatgaacgtcgggtccgccgaggcctaccggaggggaaggggcgtgggagttgggtctcactccattagtagtaatagtcgacctacagatactacgcagactacactgaacgggccactccacatcctaccagacgacaaccgacaaagaactcactgtaatctagaactaaaagtcgaaactacgccgtaggaagacggaccggaaggaccgaacgggtcttcggtagttaacgttaccgtaggtacggacggaaggtaaggagttaaccgttaattacgttacccgaacgggtaacccccgtagtttaccggtttacg

SEQ ID NO: 344689 - DNA, 544 bp, Homo sapiens
  misc_feature: GZ8MTXP02IARR8.11.27.C05.1.454.CMB.2.raw
  modified_base (362)..(362): a, c, t, g, unknown or other
  misc_feature (362)..(362): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctgggtcaagccgtggggggtccctgagactctcctgcgcagcctctggattcaccttcagtagttatagcatgaactgggtccgccaggctccgaggggaaggggctggagtgggtctcatccattagtagtaatagtcgcctanagatactacgcagactcactgaacggtccgactcaccatctccagacgacaacgaccaaagaactcactagtatcctagactaaatgaaacagcctagaacgacgaccggaaggacgacggctgtagttattactggtcgacgagaggagaactattactcgtacggaccccgtatcgttcg

SEQ ID NO: 344690 - DNA, 525 bp, Homo sapiens
  misc_feature: GZ8MTXP02FP1N2.11.27.C05.1.454.CMB.2.raw
  modified_base (332)..(332): a, c, t, g, unknown or other
  misc_feature (332)..(332): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgcaggctccgagggaggggctggagtgggtctnatccaattagtagtaaatagtcgcctacagatactacgcngactcactgaacgggcactcacanctccagagacaacgccaaagaactcactgtatctagacaaatgaaacagcctgagacgaccggagacgacggctgtcgtattactgtgcgagaggagctattactacgtcggaaccccgtatcgtttcg

SEQ ID NO: 344691 - DNA, 595 bp, Homo sapiens
  misc_feature: GZ8MTXP02IA5KR.11.27.C05.1.454.CMB.2.raw
  modified_base (302)..(302): a, c, t, g, unknown or other
  misc_feature (302)..(302): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtgggagtctggggggaggcctggtcaagccgtggggggtccctgagactctcctgcgcagcctctggattcaccttcagtagttatagcatgaactgggtccnccgaggcctaccgaggggaaggggctggagtgggtctcatccattagtaagtaatgtcgacctacagatactacgcagactcacgtagaacggggcccgactccaacccatcctaccaagaacgaaccaaacgaccaaagaactcactagtaactctacgaactaaaagtacgaaacaacgccctaggaagacggaccggaaggaccgaacgggcttaggtacgttattaacgttggcggacggacggaggagtaacttaattacgtacgtaccggaacccgtagttcgttcg

SEQ ID NO: 344692 - DNA, 569 bp, Homo sapiens
  misc_feature: GZ8MTXP02JPTUY.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccaggctccgagggaaggggctggagtggggtctcatccattagtagtaatagtgcctacagatactacgcagactcactgaaggccgactcaccatctccagacgacaacgccaaagaactcactgtactctagacaaaatacgaacagcctaggaagacggaccggaaggaaccgtaacgggagttacgtgttaatttaaccgtggttacgacgacggaagggagtaactaagttataccgtacggaaacccccgtattcgtttacg

SEQ ID NO: 344693 - DNA, 522 bp, Homo sapiens
  misc_feature: GZ8MTXP02IG1HX.11.27.C05.1.454.CMB.2.raw
  modified_base (400)..(400): a, c, t, g, unknown or other
  misc_feature (400)..(400): n is a, c, g, or t
  modified_base (491)..(491): a, c, t, g, unknown or other
  misc_feature (491)..(491): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgagggaaggggctggagtggggtctcgatccattagtagtaatagtgcctacagatactacgcagactcactgaacggggccactcaccanctcagagacaacgccaaagactcactgtatctgacaaatgaacagcctagacgagccgagacacggctgtgtattactgcgcgagagagtntaattatcgacggtaccccgattcggtttcg

SEQ ID NO: 344694 - DNA, 549 bp, Homo sapiens
  misc_feature: GZ8MTXP02H6KVR.11.27.C05.1.454.CMB.2.raw
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
  modified_base (541)..(541): a, c, t, g, unknown or other
  misc_feature (541)..(541): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaaggtgtccagtgtgaggtgcagctgtggagtctgggggagcctgatcaagccgtggggggtccctgagactctcctgcgcagcctctggatcaccttcagtatatagcatgaactgggtcccgcaggctccgaggggaaggggctggagtgggtctcatcattagtagtaatacgngacctacagatactacgcagactcactgaacgggccactcaccntcnccagacgacaacgaccaaagactcacngttanctgacaaatgaacngacctgacgagacccgagacgacggtctaggttgtaattacgtggtacgacgaggaacgtaagtaccttaagttacgtccgttaaccggaaaccccgttntttaccgg

SEQ ID NO: 344695 - DNA, 551 bp, Homo sapiens
  misc_feature: GZ8MTXP02G9YHW.11.27.C05.1.454.CMB.2.raw
  modified_base (302)..(302): a, c, t, g, unknown or other
  misc_feature (302)..(302): n is a, c, g, or t
  modified_base (408)..(408): a, c, t, g, unknown or other
  misc_feature (408)..(408): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccnccaggctccgagggagggctggagtgggtctcatccattagtagtaatagtcgcctacagatactacgcagactcactagaacgggccgactcaccatcctcaganacacgaccaagactcactgtaatctagacaaatacgaacacgcctaggacgacggccggaaggacgacggcttcgtagttatacgtggtcgacggaacgnggacgtcttaattacgtccgtacggaaccccgtatacgtttcg

SEQ ID NO: 344696 - DNA, 617 bp, Homo sapiens
  misc_feature: GZ8MTXP02G4ESE.11.27.C05.1.454.CMB.2.raw
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggngtgggtctcatccattagtagtaatgtcncctacagatactacgcagactcactggaacgggccgactccgaccactcctaccaagacgaacaaaccgacccaaacgtaacctcaacttgtaatctagacctaaaagtacgaaaaccgtagaccctaggaaacggacgacccgggaaacggaccgaccgggggtacttacggttaggttaacgtttaccgtggtaggaccggaaggaggtacgaacgttaatttaacgtccgtacggtaaaccccctagttcgtttaccg

SEQ ID NO: 344697 - DNA, 549 bp, Homo sapiens
  misc_feature: GZ8MTXP02IF9OW.11.27.C05.1.454.CMB.2.raw
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (451)..(451): a, c, t, g, unknown or other
  misc_feature (451)..(451): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctctgctgggttttccttgttgctattttagaaggtgtccagtgtgaggtgcagctggtggagtcgtgggggaggcctggtcaagccgtgggggtccctgagactctcctgcgcagcctctggattcaccttcagtagtatagcatgaactggtccgccaggctccgaggggaaggggctgggagtgggtctcatccattagtagtaatagtgcctacagatactacgcagactcactgaacgggccaactcaccatcnccaganacaacgccaaagaacctcactgtaatcctagacaaaagtgaaacncgcctgagacgccgaaggacacggctaggtgttaacttacgtggtcgacgagaaggaagtacttaattactcgttaccgggaaaacccctagtttcgg

SEQ ID NO: 344698 - DNA, 592 bp, Homo sapiens
  misc_feature: GZ8MTXP02FS8I7.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcacgcctctggattcaccttcagttagttatagcatgaactgggtccgccaggcctccggaggggaggggcgtggagtgggtctcatcctattagtagtaatagtcgacctacagactactacgcacgactcactaggaacggggccactccaaccatcccaccaagacaacaaccgaccaaagaacctacactgtactctgaacaaatacgaaacagacctaggacgagggaccccgaggaaccctagggccttaggtagttaatttacgtggtacggacggaagaggagtaaccgttattacgtacgtaaccggaaccccgtattcggttttacg

SEQ ID NO: 344699 - DNA, 531 bp, Homo sapiens
  misc_feature: GZ8MTXP02IRCJJ.11.27.C05.1.454.CMB.2.raw
  modified_base (475)..(475): a, c, t, g, unknown or other
  misc_feature (475)..(475): n is a, c, g, or t
  modified_base (522)..(522): a, c, t, g, unknown or other
  misc_feature (522)..(522): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaggggctggagtgggtctcatccattagtagtaatagtcgcctacagactactacgcagctcactgaacgggcgactcaccatctccagacgacaacgccaaagaactcgactgtatctgacaaatcgaacagcctgagcgaccgaggacacggctgtntattctagtgacgagaggagcttattacgtacgtacggaaacccgtntcgtttacg

SEQ ID NO: 344700 - DNA, 528 bp, Homo sapiens
  misc_feature: GZ8MTXP02ILAO0.11.27.C05.1.454.CMB.2.raw
  modified_base (518)..(518): a, c, t, g, unknown or other
  misc_feature (518)..(518): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaggggctggagtgggtctcatccattagtagtaatagtgcctacagatactacgcagactcactgaacgggccgactcaccatcctcagagacaacgccaaagactcactgtatctagacaaatgaacacgcctagagagccgaggacacggctgtgttatacgtgtcgcgagaggactcgtattactcgtacggaaaccccngtacgtttcg

SEQ ID NO: 344701 - DNA, 545 bp, Homo sapiens
  misc_feature: GZ8MTXP02JACOX.11.27.C05.1.454.CMB.2.raw
  modified_base (360)..(360): a, c, t, g, unknown or other
  misc_feature (360)..(360): n is a, c, g, or t
  modified_base (498)..(498): a, c, t, g, unknown or other
  misc_feature (498)..(498): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagcctggggggtccctgagactctcctgcgcagcctctggattcaccttcagtagttatagcatgaactgggtccgccaggctccgagggaggggctggagtgggtctcatccattagtagtaatagtcgcctanagatactacgcagactcactgaacgggccgactcaccatctaccagacgacaacgccaaagactcactgtatctagacaaatgaacagcctagagagaccggagacgacggctgtagttattacgtgtacgcgaaggnggagaaccgttaattacgtaccgtacggaaccccgtagtcgtttacg

SEQ ID NO: 344702 - DNA, 546 bp, Homo sapiens
  misc_feature: GZ8MTXP02GW1WV.11.27.C05.1.454.CMB.2.raw
  modified_base (411)..(411): a, c, t, g, unknown or other
  misc_feature (411)..(411): n is a, c, g, or t
  modified_base (534)..(534): a, c, t, g, unknown or other
  misc_feature (534)..(534): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccaggctccgaggggaggggctggagtgggtctcatccattagtagtaatagtcgcctacagatactacgcagactcactagaacgggccgactccgaccatcctacaganacaacgaccaagaactcactgtatctagacaaatagaacagcctagagacgaccgaggacgacggctgtagtattacgtggtacgcgaggaggagcgttaattactccgtacggaaccccgtnttacggtttacg

SEQ ID NO: 344703 - DNA, 591 bp, Homo sapiens
  misc_feature: GZ8MTXP02ISQQ5.11.27.C05.1.454.CMB.2.raw
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (422)..(422): a, c, t, g, unknown or other
  misc_feature (422)..(422): n is a, c, g, or t
  modified_base (507)..(507): a, c, t, g, unknown or other
  misc_feature (507)..(507): n is a, c, g, or t
  modified_base (556)..(556): a, c, t, g, unknown or other
  misc_feature (556)..(556): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgcccgacggctccgaggggaaggggcgtggaggtggtctcntacctattagtagtaatagtcgacctacagatactacgacncgactcacgtagacgggaccgactcaccatcctcaaganaaccaaacgcccaaagtaccactactgtacttactagacaaatcggaacagccctagacgacgaccgaggaacgacgcttaggtnttaaagtttctaggtcgacggaagagggtaagtaacttacgtttaaacnccggttaaccgggaaaccccttagttgttttaccg

SEQ ID NO: 344704 - DNA, 522 bp, Homo sapiens
  misc_feature: GZ8MTXP02I4X5G.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaggggctggagtgggtctcatccattagtagtaatagtgcctacagatactacgcagactcactgaagggccgactcaccatctcagagacaacgccaagaactcactgtatctgacaaatcgaacagcctagagacgacgagacgacgctgtgtattacgtgtgcgagacgagctagttactacgtacgaccccgtagtcgtttcg

SEQ ID NO: 344705 - DNA, 565 bp, Homo sapiens
  misc_feature: GZ8MTXP02GYFF5.11.27.C05.1.454.CMB.2.raw
  modified_base (303)..(303): a, c, t, g, unknown or other
  misc_feature (303)..(303): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggattcacctttcagtagttatagcatgaactgggtccncaggctccgagggaaggggctggagtgggtctcgatccattagtagtaatagtcgcctacagatactacgcagactcactgaacgggccgactcaccatcctaccagagaacaacgccaaagaactcactgtaatcctagacaaatcgaaacagccctaggacgacgcccggaaggaccacgggctggtagtattaccgngtacggaccgaagagggagccgttaattacgtacgtaccggaacccccgtagtcggtttccg

SEQ ID NO: 344706 - DNA, 530 bp, Homo sapiens
  misc_feature: GZ8MTXP02JQSKY.11.27.C05.1.454.CMB.2.raw
  modified_base (494)..(494): a, c, t, g, unknown or other
  misc_feature (494)..(494): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtgggtctcatccattagtagtaatagtcgcctacagatactacgcagactcactgaagggccgactcaccatctccagagacaacgccaaagaactcactgtatctagacaaatgaaacagcctagagacgccgaaggaccaggctagtagtattacgtgtcgcgagngagtcgtattactcgtacggaaacccctgtcgttcg

SEQ ID NO: 344707 - DNA, 531 bp, Homo sapiens
  misc_feature: GZ8MTXP02I4CA1.11.27.C05.1.454.CMB.2.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (495)..(495): a, c, t, g, unknown or other
  misc_feature (495)..(495): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccnccaggctccgagggaggggctggagtgggtctcatccattagtagtaatgtgcctacagatactacgcngactcactgaacgggccgactcaccatctaccagagacaacgccaaagaactcactgtaatctgacaatcgaacagccctgagacgaccggaggaccacggctagtgtattacgtgtcgcgagnggatcgtattactacgtacggacccgatcgtttacg

SEQ ID NO: 344708 - DNA, 515 bp, Homo sapiens
  misc_feature: GZ8MTXP02FJJUN.11.27.C05.1.454.CMB.2.raw
  modified_base (372)..(372): a, c, t, g, unknown or other
  misc_feature (372)..(372): n is a, c, g, or t
  modified_base (511)..(511): a, c, t, g, unknown or other
  misc_feature (511)..(511): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggaggcctggtcaagcctggggggtcccctgagactctcctgcgcagcctctggattcaccttcagtagtatagcatgaactggggtccgccaggctccaggggaaggggctgggagtggggtctcatccattagtagtaatagtgcctacagatactacgcngactcactgaagggccgactcaccatctcccagagaccaacgccaaagaactcactgtatctgcaaatgaaacagcctgagagccgaggacacggctgtgtattactgtgcgagagagctattatctaggaaccccgancgtc

SEQ ID NO: 344709 - DNA, 596 bp, Homo sapiens
  misc_feature: GZ8MTXP02GMCE3.11.27.C05.1.454.CMB.2.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgcaggctccgagggaaggggctggagtgggtctcatccattagtagtaatagngcctanagatactacgcngactcactgaacgggccgactacaccatctccagacgacaaacgccaaagaactacacctagtatacctgaccaaaatacgaaacagaccctaggaacgagacccggaaggaaccgaacgggccttaggttacgttaaagtttaacctggttaggaccggaaaggagggaagtcgttaattaacttaccgttaacggaaacccccggtaagttacggtttttccg

SEQ ID NO: 344710 - DNA, 581 bp, Homo sapiens
  misc_feature: GZ8MTXP02J4JA4.11.27.C05.1.454.CMB.2.raw
  modified_base (277)..(277): a, c, t, g, unknown or other
  misc_feature (277)..(277): n is a, c, g, or t
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggtaggcctggtcaagccgtggggggtccctgagactctccctgcgcagcctctggattcaccttnagtagttatagcatgactgggtccgcaggctccgaggggaaggggcgtggagtgggtctcatcctattagtagtaatagtcgcctacagatactaacgcngactcactgaagggccgactcacatctcagagacaacgaccaagaactcactgtatctgnaanagaacagccgngacggagaccgggacggaaccgtacgggaccgttcgttagttagtttaaccttacgttggtaccggacggaaggtaacggttcgttaactttacgttaccgtaccggtaaccccgtacgttacggtttcg

SEQ ID NO: 344711 - DNA, 593 bp, Homo sapiens
  misc_feature: GZ8MTXP02H8BGD.11.27.C05.1.454.CMB.2.raw
  modified_base (304)..(304): a, c, t, g, unknown or other
  misc_feature (304)..(304): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagccctcgtggattcacctttcagtagttatagcatgaactgggtccnccgaggcctccgaggggaaggggctggaggtgggtctcatccaattagtaagtaatagtcgcctaacagatactacgcagactcacgtaggaaacgggcccaactccaaccctatccctacccaaggaacgaaccaaacggaccaaaacggtaacctccaactgtaactccgtagacaaaagtgaacgatacgacgagacggacgacggacgacgtacgtcgtagtattaactcgttcgagacggagagggaacgtatacttactacggtacccgaaccgttagtttcg

SEQ ID NO: 344712 - DNA, 593 bp, Homo sapiens
  misc_feature: GZ8MTXP02HGO07.11.27.C05.1.454.CMB.2.raw
  modified_base (328)..(328): a, c, t, g, unknown or other
  misc_feature (328)..(328): n is a, c, g, or t
  modified_base (549)..(549): a, c, t, g, unknown or other
  misc_feature (549)..(549): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgccgcagcctctggacttcaccttcagttagtatagcatgaacgtgggtccgccaggctccgaggggagggctggngtgggtctcatccagttagtataatgtcgacctacagactactacgcacgactcacgtggaacgggccgactaccaaccatccctacgaagaacgaaccaaaccgtaccaaagtaacctcaactgtactcgtacgaactaaagtcgaaactacgaccgtagggacgacggacccgggagggacctacggcttaggtacgttattacgtggcggagaagggngacgtcttaagttcgtaccgtacgggaacccctattcggtttcg

SEQ ID NO: 344713 - DNA, 513 bp, Homo sapiens
  misc_feature: GZ8MTXP02G15I6.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtggggtctcgatccattagtagtaatagtgcctacagatactacgcagactcactgaagggccgactcaccatctccagagacaacgccaaagaactcactgtatctgacaaatgaacagcctgagagccgaggacacggctgtgtattactgtgcgagaggagctattactctaggacccatgttc

SEQ ID NO: 344714 - DNA, 648 bp, Homo sapiens
  misc_feature: GZ8MTXP02FNVVD.11.27.C05.1.454.CMB.2.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (398)..(398): a, c, t, g, unknown or other
  misc_feature (398)..(398): n is a, c, g, or t
  modified_base (486)..(486): a, c, t, g, unknown or other
  misc_feature (486)..(486): n is a, c, g, or t
  modified_base (592)..(592): a, c, t, g, unknown or other
  misc_feature (592)..(592): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggcctggtcaaggccgtggggggtccctgacgactctcctgcgcacgcctcgtggtacttccaccttcagttagttanagcatgaacgtcgggtccnccgaggcctaccggaggggaaggggctggggaggttcgggtctcatcctagttagtaagtaatagtcgacctacatactactacgacngacctacacgtacggaacggggcccactcccaacctataccctacccgaagaacgaaaccaaaccgacccaaagtaacctacacgttntacttacagaacaaagtacgaaacgtacgcccgaggaacggacggaccggaagggtaccacgggttcgttagttacggttattaaccggttggaggacgggaaggngggtaactaacgttacttacgttaccggtaccggaacccttaggttccttttacgg

SEQ ID NO: 344715 - DNA, 697 bp, Homo sapiens
  misc_feature: GZ8MTXP02JVB5K.11.27.C05.1.454.CMB.2.raw
  modified_base (610)..(610): a, c, t, g, unknown or other
  misc_feature (610)..(610): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtacacggccgggtcgggggtccctggacgtactcctccgtgcgcacgtcctcgtgtacttcctaccttctagttagttatagctagtagacgtcgggtcccacgacggtcctacgggaagggggaggggtcgtagggagggttcgggtcctacgtacctaccgtaaagtttaaggttaaagtaaagttaggtccctaacctaagtaagaacttaacgtacgacgacgtaccttacgacgtaacgggaacgggccctaaccgtaccaacctacgttcccacccgaaggaaccaaccgaacccgacaaacgtaaccactacgtatactcgtagaactaaagtacaacgacgtaccgaaggaacgaccggacgggtaagaccgtaacggtnttacggtacgttacttacgtggtacgggacaggggaacggataacgttaagtaccgttcggaacccggaccttaggttcgtttaacg

SEQ ID NO: 344716 - DNA, 600 bp, Homo sapiens
  misc_feature: GZ8MTXP02GHFU4.11.27.C05.1.454.CMB.2.raw
  modified_base (299)..(299): a, c, t, g, unknown or other
  misc_feature (299)..(299): n is a, c, g, or t
  modified_base (583)..(583): a, c, t, g, unknown or other
  misc_feature (583)..(583): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccgaggggaaggggctggagtgggtctcatccattagtagtaatgtcgcctacagatactacgcagactcactgacgggggccactcaccatcctaccagacgaccaaacgcccaaagaacctcactgtaatcctagacaaaatggaaacagccctagacgacgcccgaagggaccgaacgggcttaggttggttaaactttaccgtgggttacgacggaaaggtaggggtaatccgtttaaatttaacgtttcgaacccggggtaaaacccccgtntttacggggtttttccg

SEQ ID NO: 344717 - DNA, 569 bp, Homo sapiens
  misc_feature: GZ8MTXP02HQRB0.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggcgtggagtgggtctcatccattagtagtaatagtcgcctacagatactacgcagactcactgaacgggccgactccaccatcctccaagacgaacaacgccaaagaacctacactgtatctagacaaatcgaaacagacctagaacgacgaccggaaggaccacgggctaggtcgttattacgtggtcgacgacggaaggacggtaacttaagttacgtaccgtacggaacccccgtattacgtttccg

SEQ ID NO: 344718 - DNA, 603 bp, Homo sapiens
  misc_feature: GZ8MTXP02GG2HN.11.27.C05.1.454.CMB.2.raw
  modified_base (543)..(543): a, c, t, g, unknown or other
  misc_feature (543)..(543): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctcgtggacttcaccttcagtattatagcatgaacgtgggtccgccgaggcctccgaggggaaggggctgggagtgggtctcgatccatttagtataatgtcgacctacagatactacgcagactcacgtgaaacgggccgactccaccatcctaccgaagacgaaccaacgacccaaagaaccctcaacttgtaaactcgtagacaaagtcgaaacacgccgtagacgacggaccgacggaacgcggtactggttagttacgttacgtggtgaccgggtaaggnggtaactaacgtttaattaacgtccggtaaccggtaaaccccgtagtttccgttttaacg

SEQ ID NO: 344719 - DNA, 566 bp, Homo sapiens
  misc_feature: GZ8MTXP02JR3ZQ.11.27.C05.1.454.CMB.2.raw
  modified_base (361)..(361): a, c, t, g, unknown or other
  misc_feature (361)..(361): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaaggggctggagtgggtctcatccattagtagtaatagtcgcctanagatactacgcagactcacgtagaacggggccgactccgaacccattcctacccaggacgaaccgaaacgacccaaagaacccttcacctgttaaactcgtagactaaaatcgaaacagccctagacgacgcgaggacgacgctagtgtatacgtgcgacgagaggagcttaattacgtacgtacggaaccccagttccgtttag

SEQ ID NO: 344720 - DNA, 526 bp, Homo sapiens
  misc_feature: GZ8MTXP02FK9SR.11.27.C05.1.454.CMB.2.raw
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggctccgaggggaaggggctggagtgggtctcatccattagtagtaatagtcgcctacagatactacgcagactcactgaacgggccgactcaccatcctccagacaacaacgaccaaagaactcactgtatctgacaaatagaacagcctagagagccgaggacacgctgtgtatacgtgtagcgagagagctattacncgtacgaaccctagtcgtttacg

SEQ ID NO: 344721 - DNA, 601 bp, Homo sapiens
  misc_feature: GZ8MTXP02JAFOQ.11.27.C05.1.454.CMB.2.raw
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaggggctggagtgggtctcatccagttagtagtaatgtcgacctanagatactacgacngactcacgtgaacggggccactccaccatccaccaagacgaaccaacgacccaaagaacctcaactgtaaactcctagactaaaagtcgaaacagcccgtagaaggacggaccggagggaaaccgtacgggccttaggtacgttaattaccggttagtacgggacgaaggagggtactaacgttaagttaccgtcggtaaaaccgggtacccctgtttcgttttacg

SEQ ID NO: 344722 - DNA, 611 bp, Homo sapiens
  misc_feature: GZ8MTXP02F7X7W.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctggtcaagccgtggggggtccctgagactctcctgcgcagcctctggattccaccttcagttagttatagcatgaacgtcgggtccgccgaggctccgaggggaaggggctggaggtgggtctcgatcctattagtagtaatagtcacctacagactactacgcagactcactgaacgggccgactccaccatcctacaacgaacgaacaaccgaccaaacgaaacctacacttacgtactacttcgaacctaaaagtacgaaaaccgacgacccgtaggaaacggacggacccgggaaggaccgacggcgtgtacgtatttacgaggttagacggaaggaggaggtaacttaagttactaccgtaacggtaaccccgtagttacgtttacg

SEQ ID NO: 344723 - DNA, 518 bp, Homo sapiens
  misc_feature: GZ8MTXP02F3A5T.11.27.C05.1.454.CMB.2.raw
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagtatagcatgaactgggccgccaggctccgaggggaaggggctggagtgggtctcatccattagtagtaaatagtgccctanagatactacgcngactcactgaagggcactcacatctcanacgacaacgaccaagaactcactgtatctgacaaatagaacagcctagagagaccgaggacgtacggctgtgtatactgtcgcgagagagctatatcgtacgaacccgtatcgtttacg

SEQ ID NO: 344724 - DNA, 544 bp, Homo sapiens
  misc_feature: GZ8MTXP02GDF47.11.27.C05.1.454.CMB.2.raw
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccaggggaaggggctggagtggggtctcactccattagtagtaaatagtcgcctacagatactacgcngactcactgaacgggccgactcaccatctccaganaacaacgccaaagaactcactgtatctgacaaatagaacagccctaggagacggacgaggaccgacggctgtacgtattactggtgcgaaggaggagtaacgtattactcgacggaaacccctgtcgttttaccg

SEQ ID NO: 344725 - DNA, 533 bp, Homo sapiens
  misc_feature: GZ8MTXP02JMJLN.11.27.C05.1.454.CMB.2.raw
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcatccattagtagtaatgtcgcctacagatactacgcagactcactgaagggccgactcaccatctccagagaacaacgccaaagaacctcactgtaatctagacaaatgaaacagcctagagacgccgaggacacggctgtagtattacgtgtcgcgagaggancgtattactcgtacggacccctagtcgtttacg

SEQ ID NO: 344726 - DNA, 545 bp, Homo sapiens
  misc_feature: GZ8MTXP02G1CXG.11.27.C05.1.454.CMB.2.raw
  modified_base (407)..(407): a, c, t, g, unknown or other
  misc_feature (407)..(407): n is a, c, g, or t
  modified_base (495)..(495): a, c, t, g, unknown or other
  misc_feature (495)..(495): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgccaggcctccgaggggaaggggctggaggtgggtctcatccattagtagtaaatagtgcctacagatactacgcagactcacgtagaacgggccgactcaccatccnccagacacaacgcaagaactcactgtatctagacaaagtcgaactacgccctagacgacgccggaacggacacggctgtgtattacgngtacgcggagaggagcttattacttcgtacgggaacccctgtcgtttacg

SEQ ID NO: 344727 - DNA, 581 bp, Homo sapiens
  misc_feature: GZ8MTXP02H25B2.11.27.C05.1.454.CMB.2.raw
  modified_base (303)..(303): a, c, t, g, unknown or other
  misc_feature (303)..(303): n is a, c, g, or t
  modified_base (530)..(530): a, c, t, g, unknown or other
  misc_feature (530)..(530): n is a, c, g, or t
  modified_base (558)..(558): a, c, t, g, unknown or other
  misc_feature (558)..(558): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaaggccgtggggggtccctgagactctcctgcgcagccctctggacttccaccttcagtagttatagcatgaactgggtccnccgaggctccgagggacgggcgtggagtgggtctgatccattagtagtaatagtcgacctacagatacgtacgcagactacacgtaggaacggcccgactcgaccctatcacccagacgaccaacgaccaaacgacctcacttagactacgttagaactaaaagtgaaccgagtccgtagaacgacggaccgaaggtaccgacgggtcttaggtacgtttacttacnggtcgacggaggagagtaactagttacncgtaccgacccgtattcgttacg

SEQ ID NO: 344728 - DNA, 616 bp, Homo sapiens
  misc_feature: GZ8MTXP02HAH72.11.27.C05.1.454.CMB.2.raw
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggcctccggaggggaaggggctgggaggttgggtctcatcctattagtagtaatagtcgcctanagatactacgcagacctacacgtgaaacgggccgactaccaccatcctacagacaacaaccgccaaagaacctacactgtaatctagaacaaatgaaacacgtacccgaggaacgacgacccggaaggaccgacggggcctacggttagttaacgtttacgtaggttacggacggtaacggaagggtaggtaaccttaatttaccgtaccgtaaccgggggtaacccccgtagtacggtttttaccgg

SEQ ID NO: 344729 - DNA, 530 bp, Homo sapiens
  misc_feature: GZ8MTXP02GIMB5.11.27.C05.1.454.CMB.2.raw
  modified_base (499)..(499): a, c, t, g, unknown or other
  misc_feature (499)..(499): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgcaggctccgagggaaggggctggagtggggtctcatccattagtagtaatagtgcctacagatactacgcagactcactgaacgggccgactcaccatcctccagagacaaacgccaaagaactcactcgtatctgacaaatgaaacagacctagagagaccgagacacggctgtgtattactgtagcgtagaggacgngtattatcgtagaaccccgtagtcgtttacg

SEQ ID NO: 344730 - DNA, 563 bp, Homo sapiens
  misc_feature: GZ8MTXP02H9HMK.11.27.C05.1.454.CMB.2.raw
  modified_base (345)..(345): a, c, t, g, unknown or other
  misc_feature (345)..(345): n is a, c, g, or t
  modified_base (416)..(416): a, c, t, g, unknown or other
  misc_feature (416)..(416): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtgggaggtcgtggggggaggcctggtcaaggccgtggggggtccctgagactctcctgcgcagcctctggattccacccttcagtagttatagcatgaacgtgggtccgccaggcctccgaggggaaggggctggagtggggtctnatccattagtagtaatagtcgcctacagatactacgcagaccttcacgtagaacggggcccgatccaccancctaccagagaccaacgaccaaagaactcactgtactctgacaaatgaacacgcctagagacgccgaaggacacggctagtcttatacctggtcgcggaacgaggagaacttattacgtcgtaccggtaccccgtaattcgtttacg

SEQ ID NO: 344731 - DNA, 520 bp, Homo sapiens
  misc_feature: GZ8MTXP02ICAZB.11.27.C05.1.454.CMB.2.raw
  modified_base (398)..(398): a, c, t, g, unknown or other
  misc_feature (398)..(398): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaaggggctggagtggggtctcgatccatagtagtaatagtgcctacagatactacgcagactcactgaagggccgactcacccancctcagagacaacgcaaagaactcactgtatctgacaaaatgaaacagcctagagagccgaaggacacggctgtagtattactgtgcgagaggagctatatctacggaccccgtattctttg

SEQ ID NO: 344732 - DNA, 595 bp, Homo sapiens
  misc_feature: GZ8MTXP02I42HN.11.27.C05.1.454.CMB.2.raw
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggcctccgaggggaacggggctggagtggggtctcactccagttagtagtaatgtcgctanagactactacgcagactcacgtagaacgggccgactacaccagttcccncaagacaaaccgaacgaccaaagaactcgaacttgtaatctagactaaatcgaaactgacctagaagacggaccggaaggaccgacggtactggttacgttaattacgtggttacgccggtaaaggaggtaacggtaactttattaacgtacgtaaccgggtaaccccagtttcgtttacg

SEQ ID NO: 344733 - DNA, 516 bp, Homo sapiens
  misc_feature: GZ8MTXP02FZYY9.11.27.C05.1.454.CMB.2.raw
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtggggtctcatccattagtagtaatagtgcctacagatactacgcagactcactgaagggccgactcaccatctccagagacaacgccaagaactcactgtatctgacaaatgaacagcctgagagccgaggacacggctgtgtattactgtgacgagagagntatactcgtacggaaccccatcgttcg

SEQ ID NO: 344734 - DNA, 582 bp, Homo sapiens
  misc_feature: GZ8MTXP02JHQDE.11.27.C05.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctntggattcaccttcagtagttatagcatgaactgggtccnccaggctccgaggggaggggctggagtgggtctcatccattagtagtaaatgtcgacctanagtatactacgcagactcactgaacgggccactcaccntcctcagacgaacacgaccaaagaactcactgtatctagacaaatcgaacagccgtagagaacgccgaaggtaccgacgggtcttaggtacgttaaagttaccgtggtcggacgaacggagggtaagtaaccgttaagtttacgtacggtaccggaaacccccgtagttccgttttaacgg

SEQ ID NO: 344735 - DNA, 558 bp, Homo sapiens
  misc_feature: GZ8MTXP02JNXA2.11.27.C05.1.454.CMB.2.raw
  modified_base (365)..(365): a, c, t, g, unknown or other
  misc_feature (365)..(365): n is a, c, g, or t
  modified_base (508)..(508): a, c, t, g, unknown or other
  misc_feature (508)..(508): n is a, c, g, or t
  modified_base (558)..(558): a, c, t, g, unknown or other
  misc_feature (558)..(558): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggggtccgctgggtttttcctgttgtctatttttagaaggtgtccagtgtgaggtgcagctggtggagtctgggggaggcctgggtcaaggcctggggggtccctgagacctctcctgcgcagcctctggattcaccttcagtagttatagcatgaactgggtccgccaggctccgaggggaggggctggagtgggtctcgatccattagtagtaatagtcgcctanagactacagctagactcaacgtgaaagggccaactcacccatcctaccaagacgaccaaacgcccaaagtaacctcgacttgtaatcctagaccaaaagtagaacagaccgacgagaggacgacggacgacgcgtcgtagttnactgtcgcgacgagagtaacgtactcgtacgtacgtaccgtaccgtacgn

SEQ ID NO: 344736 - DNA, 549 bp, Homo sapiens
  misc_feature: GZ8MTXP02HYM1Q.11.27.C05.1.454.CMB.2.raw
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccncaggctccgaggggaaggggctggagtgggtctcatccattagtagtaatagtgcctacagatactacgcngactcactgaacgggccgactccaccatcctccagacgacaaacgaccaagaactcactgtatctgacaaatagaacagcctagagacgacgaacggacacggctgtagttattactggtagacgaggaggagtaaccttaagttactaccgtacggaacccccgtattacgtttcg

SEQ ID NO: 344737 - DNA, 579 bp, Homo sapiens
  misc_feature: GZ8MTXP02FW03E.11.27.C05.1.454.CMB.2.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagtcgtggggggtccctgagactctcctgcgcagcctctggattcaccttcagtagttatagcatgaactgggtccncaggctccgaggggaggggctggagtgggtctcatcctattagtagtaatagtcgcctanagatactacgcagactcacgtagaacggggcccgactccaccactcctacccaagacgaaccaaacgaccaaagaactcaactgtactctagacaaagtcgaaacagccctagacgacggacccggaaggacgaccggntacggtagttacttacgtggtagcggaaggacggagtaacttaagttactaccggtaccggaaccctagtcgttttacg

SEQ ID NO: 344738 - DNA, 566 bp, Homo sapiens
  misc_feature: GZ8MTXP02HEFIT.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcgatccattagtagtaatagtcgcctacagatactacgcagacctcactgaagggccgactccaccatcctaccagagacaacgccaaagaactcgactgtatctagactaaaatcgaaaactagaccctaggacgacggccgaagggaaccgacgggccttaggtagttattacgtgtacggacgaggaggagcttagttactcgtacggaaccccgtagttcgtttacg

SEQ ID NO: 344739 - DNA, 535 bp, Homo sapiens
  misc_feature: GZ8MTXP02F6ABZ.11.27.C05.1.454.CMB.2.raw
  modified_base (401)..(401): a, c, t, g, unknown or other
  misc_feature (401)..(401): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtgggtctcatccattagtagtaatagtcgcctacagatactacgcagactcactgaacgggccgactcaccatcncagagacaacgcaaagaactcactgtatctagacaaatgaaactagaccctgacgacgaccggaggacgacggctggtagtattacgtgtgacgaggaggagcttagtactcgtacggaccctagtcgtttacg

SEQ ID NO: 344740 - DNA, 570 bp, Homo sapiens
  misc_feature: GZ8MTXP02HU6PP.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcacctttcagtagttatagcatgaactgggtacccgccaggctccgaggggaaggggctggagtgggtctcatcctattagtagtaatagtcgacctacagtaatactacgcagacctcacgtagaacggggccactccacactcacagagaacaaacgaccaagaactcactagtattctagactaaatagaacacgcctagagacggacggaggacgacggctgtacgttattacgtgttacgcggtaggaggtagtaacgttacttacgtacgtacggtaaccccgagtttcgtttacg

SEQ ID NO: 344741 - DNA, 579 bp, Homo sapiens
  misc_feature: GZ8MTXP02JT68Y.11.27.C05.1.454.CMB.2.raw
  modified_base (426)..(426): a, c, t, g, unknown or other
  misc_feature (426)..(426): n is a, c, g, or t
  modified_base (528)..(528): a, c, t, g, unknown or other
  misc_feature (528)..(528): n is a, c, g, or t
  modified_base (542)..(542): a, c, t, g, unknown or other
  misc_feature (542)..(542): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtcctgagactctcctgcgcagcctctggattctaccttctagtagttatagcatagaacgtcgggtccgccgacggcgtccgaggggaaggggcgtggaggtgggtcgtcactaccattagttagtaatagtcgcctacagatactacgcacgactacacgtagaacgggaccgacctacacccattccnccaagacgaaccaaccgaccaaagtaactcactagtatcctagaccaaaatcgaacagcctgaacggacgcccgtagggaccacgggcttggtatattacgngtggacgagacggnaacttattaacgtcgtaccggaacccgtatgtttacg

SEQ ID NO: 344742 - DNA, 526 bp, Homo sapiens
  misc_feature: GZ8MTXP02F0XYN.11.27.C05.1.454.CMB.2.raw
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgaggggaaggggctggagtgggtctcatccattagtagtaatagtncctacagatactacgcngactcactgaagggccgactcaccatctccaganacaacgccaaagaactcactgtatctagacaaaatgaaacagcctagagagccgaggacacggctgtgtattacgtgtgacgagaggagctaattacgactacggaaccccgatcgtttcg

SEQ ID NO: 344743 - DNA, 599 bp, Homo sapiens
  misc_feature: GZ8MTXP02H5RS3.11.27.C05.1.454.CMB.2.raw
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttanagcatgaacgtcgggtccnccgaggcctccgaggggaaggggctggaggtgggtctcatccattagtagtaatagtcgacctacagataactacgcacgactacacgtaggaacggggcccaactccaaccctaactccctcccaaggaacgaaccaaaaccgacccaaaagtaacctaccgacttagtaaactcttacggaacaaaagtcgaaacgacgtcccgagaacggacggaccggaaggaccgaacggctgtacgttatactggtcgacgagaggagtcgtatactcgtaccggaccctagtcgtttacg

SEQ ID NO: 344744 - DNA, 554 bp, Homo sapiens
  misc_feature: GZ8MTXP02FHG9I.11.27.C05.1.454.CMB.2.raw
  modified_base (300)..(300): a, c, t, g, unknown or other
  misc_feature (300)..(300): n is a, c, g, or t
  modified_base (520)..(520): a, c, t, g, unknown or other
  misc_feature (520)..(520): n is a, c, g, or t
  modified_base (531)..(531): a, c, t, g, unknown or other
  misc_feature (531)..(531): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccncaggctccgaggggaaggggctgggagtgggtctcatccaattagtagtaatagtgacctacagatactacgcagactcactagaacgggccactcaaccatcctcagagacaaccgcaaagaactcaactgtaatcctagacaaaagtcgaaaacctagccctaggacgacggcccgaagggaccacggctgtagttattacgtggtagcgaagagganaactatttacnccgtaggaacccctgtcgtttcg

SEQ ID NO: 344745 - DNA, 736 bp, Homo sapiens
  misc_feature: GZ8MTXP02H81CY.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaacgtggggctccgcttgggttttccttgttgcttattttagaaggtgtccagtgtgaggtgcagcgtggtgggaggttcgtggggggaggccgtgggtcaagccggtggggggtccctgagacctctcctgcgcacgccctcgtggtacttccaccttcagttagttatagactatgaacgtcgggtccgccgaggcctaccgggaggggaacggggtcgtgggaggtggggtcctcactcctaagttagtaaagtaagtagtcgacctaacagacttactacgcagacctcacgtaggaacgggtcccgactccaccctaatcccaccaaggaaacgaacccgaaaccgacccgaaaagtaaccctacctacgttacgtaacttccttaacggaactaaaaacgtacgaaaaccgacgcccgttaaggaacggaacggacccggggaaacgggtaccgaaaccggggtctttacgggtagttttaacgtttaaccgttgggtacgaaccgggaagggaaggggaacggttaacctttaaacgttaacggtttaccgtaaccccgggggtaaaacccccgtagttttccccggttttaacgg

SEQ ID NO: 344746 - DNA, 566 bp, Homo sapiens
  misc_feature: GZ8MTXP02IY1XD.11.27.C05.1.454.CMB.2.raw
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctctgcgcagcctctggattcaccttcagtagttatagcatgaactgggtccgccaggcctcgagggaaggggctggagtgggtctcatccattagtagtaatagtcgacctanagatactacgcagactcactgaacgggccactcaccatcnccagacacaacgccaaagacncactgtatctagacaaatacgaacacgccgtagacgacggaccggaggaccgacggcttagtacgttaattacgtggtacgacggaacggaggaacgtaacttaagttacgttaccggtaccggaaaccccgtagttcgtttacg

SEQ ID NO: 344747 - DNA, 558 bp, Homo sapiens
  misc_feature: GZ8MTXP02JAG3F.11.27.C05.1.454.CMB.2.raw
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (440)..(440): a, c, t, g, unknown or other
  misc_feature (440)..(440): n is a, c, g, or t
  modified_base (481)..(481): a, c, t, g, unknown or other
  misc_feature (481)..(481): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcgagccgtctggacttcaccttcagtagttatagcatgaactgggtccnccaggctccgagggaggggctggagtgggtcncatccattagtagtaatagtcgcctacagatactacgcagactcactcggaacggggtccaactcaccactcctccgagacgaacaacgaccaagaactcacgtntatctgacaaatgaactacgcctgagagccgaggaccacgngtcgtagttaagttcgtgtagcggtaaggagggataacgttataacgttcgtaccgggaaacccctgttcggtttcg

SEQ ID NO: 344748 - DNA, 638 bp, Homo sapiens
  misc_feature: GZ8MTXP02GENQN.11.27.C05.1.454.CMB.2.raw
  modified_base (365)..(365): a, c, t, g, unknown or other
  misc_feature (365)..(365): n is a, c, g, or t
  modified_base (414)..(414): a, c, t, g, unknown or other
  misc_feature (414)..(414): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtgggggtccctgagactctcctgcgcagcctctggattccaccttcagtagttatagcatgaactcgggtccgccaggctccgaggggaggggctggagtgggtctcatcctattagtagtaaatgcgacctaanagatactacgcacgactcacgtgaacggccgaactcacctatccaccanaacgaacaaaccgcaaagaacctcaaacgtgtaaactcctaggaaaccaaagtacgaaaaccgacgacccgttaaggacggaaacggacccggaagggaacccgacgggtaccttggttaacgttaaacgtttacgtggttacgggaccgaaagggtacggaagttaaccgttaagtttaacgtaccggttaccggggtaaaaccccctgtcgtttttaaccgg

SEQ ID NO: 344749 - DNA, 549 bp, Homo sapiens
  misc_feature: GZ8MTXP02HSG3F.11.27.C05.1.454.CMB.2.raw
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtctgggggaggcctggtcaagccgtgggggggtccctgagactctcctgcgcagcctctggattcaccttcagtagttatagcatgaactgggtccgccaggctccgagggaggggctggagtgggtctcatccattagtagtaaatagtgacctanagatactacgcagactnactgaaggggccgactccacatctcagagacaacgccaagaactcactgtatctagacaaatagaacagaccctagacgacggccggaacggacgaacggctacgtggttattaactggtcgacgaggaggagtcgtattactacgtacggaaccccgtagtcgtttacg

SEQ ID NO: 344750 - DNA, 546 bp, Homo sapiens
  misc_feature: GZ8MTXP02I3D5E.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagccgtggggggtcccctgagactctcctgcgcagcctctggattcaccctttcagtagttatagcatgaactgggtccgccaggctccgagggaggggctggagtgggtctcatccattagtagtaaatgtcgcctacagactactacgcagactcactgaagggccgactcaccatctccagagacaacgaccaaagaactcactgtatctagacgaaatagaaacagccctagacgacgaccggaaggacgacggctcggtagtattacgtggtgcgagaggagaacttatacgtcgtacggaccccgagtacgttacg

SEQ ID NO: 344751 - DNA, 575 bp, Homo sapiens
  misc_feature: GZ8MTXP02JCXYD.11.27.C05.1.454.CMB.2.raw
  modified_base (332)..(332): a, c, t, g, unknown or other
  misc_feature (332)..(332): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctctgcgcagcctctggattcaccttcagtagttatagcatgaactgggtccgccaggctcgaggggaggggctggagtgggtcncatccattagtagtaatagtcgacctacagatactacgcagacctcactaggacgggccgtactccaaccatcctaccgagacgaccaaacgacccaaagaacctcactgtactctgacaaatgaaacagcctagagacggaccgaggtaccacgggtctacggtgttacttacgtgtacggacgaaggagggactaacgttatttaaacgtccgtacgggtaaaacccctgttcggttttac

SEQ ID NO: 344752 - DNA, 619 bp, Homo sapiens
  misc_feature: GZ8MTXP02JOLOI.11.27.C05.1.454.CMB.2.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggattcaccttcagtagttanagcatgaacgtgggtccnccaggctccggaggggaagggctgggagtgggtctcatcctattagtagtaatgtccgcctacagactactacgcagactcacgtggaaacgggccgactccgaaccattccacccagacgaacaacgaccaaagactcacttgtatctagactaaagtacgaacagtcccgtaggacgaacggcccggaagggaacgaccgggtactttagggttacgttacgtttaaccgtggttacggacgggtaaggacgggacgttaacttagtttaaccgtccgttaccgggaacccccgttagttacggtttttaccgg

SEQ ID NO: 344753 - DNA, 519 bp, Homo sapiens
  misc_feature: GZ8MTXP02JQ3P3.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaggggctggagtggggtctcatccattagtagtaatagtgcctacagatactacgcagactcactgaagggcccgactcaccatctccagagacaacgcccaaagaacctcactgtaatctgacaaatgaacagcctgagagccgaggacacggctgtgtatactgtgcgagagagctattactcgtacgaccccgtatcgtttcg

SEQ ID NO: 344754 - DNA, 547 bp, Homo sapiens
  misc_feature: GZ8MTXP02G2FBF.11.27.C05.1.454.CMB.2.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (410)..(410): a, c, t, g, unknown or other
  misc_feature (410)..(410): n is a, c, g, or t
  modified_base (426)..(426): a, c, t, g, unknown or other
  misc_feature (426)..(426): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccnccaggctccgaggggaggggctggagtgggtctcatccattagtagtaatagtcgcctanagactactacgcagactcactgaacggggccactcaccatcctcaganacaacgccaagacctnactgtatctgacaaaatgaaactgcctaggacgagaccggagacgacggctcgtagtattacgtagtggacgagaggagtcttaaattacgtcgtaccggaaaaccccgtgtcggttttcg

SEQ ID NO: 344755 - DNA, 601 bp, Homo sapiens
  misc_feature: GZ8MTXP02G543S.11.27.C05.1.454.CMB.2.raw
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccaggcctccgaggggaaggggcgtggagtgggtctcgactcctattagtagtaatagtcgcctanagatactacgcagactcacgtagaacgggcccgactaccaccatcctccagacgaaccaacgaccaaagaacctacacgtgtaatcctagaactaaaagtcgaaacaggtaccaggaacgacggacccggaaggaccgaacggcgttaggtacgttaagttacgtggtacggaccggaggacggagtaacttaagttacgtccgtaccgggaaacccctagttcggttttacg

SEQ ID NO: 344756 - DNA, 532 bp, Homo sapiens
  misc_feature: GZ8MTXP02FV3OI.11.27.C05.1.454.CMB.2.raw
  modified_base (360)..(360): a, c, t, g, unknown or other
  misc_feature (360)..(360): n is a, c, g, or t
  modified_base (492)..(492): a, c, t, g, unknown or other
  misc_feature (492)..(492): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccgcaggctccgagggaaggggctggaggtgggtctcgatccattagtagtaatagtgcctanagatactacgcagactcactagaagggccgactcaccatcctccaagagacaacgcccaaagtaactcactgtaatctagacaaatgaaacagaccgtagagacgaccgaggacacgggctgtgtattacgngtgcgagagagctattactcgacggacccgatcggtttac

SEQ ID NO: 344757 - DNA, 531 bp, Homo sapiens
  misc_feature: GZ8MTXP02HUB1M.11.27.C05.1.454.CMB.2.raw
  modified_base (406)..(406): a, c, t, g, unknown or other
  misc_feature (406)..(406): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtcccctgagactctccctgcgcagcctctggattcaccttcagtagttatagcatgaactgggtccgccaggctccgagggaaggggctggagtggggtctcatccattagtagtaatagtcgcctacagatactacgcagactcactgaacgggccactcaccatccncagagacaacgccaaagaactcactgtatctgacaaatgaaacacgacctgagagccgaaggacacggctgtagtattactgtcgacgagaggagctattactccgaggaaccccgtatcgttcg

SEQ ID NO: 344758 - DNA, 699 bp, Homo sapiens
  misc_feature: GZ8MTXP02JFX63.11.27.C05.1.454.CMB.2.raw
  modified_base (631)..(631): a, c, t, g, unknown or other
  misc_feature (631)..(631): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcacgccctcgtggtacttcctacccttcgtagttagttaatagacctagtacgaacggttcgggtcccgacccgacggcccgtaccgggaagggggaaggggcgtagggtagggtcgggtcctacgtactacctacgtttaagtaagtaaagtgtaccgtacctaacgaagtaactacctacgtacacgactacacgtacgggaacgggcccgaacctaccaaccgtacttcccacccgaacgaaaccgaacccgaaaccgacccaaaacgtaaccctcctaacgttacgttaacctcgtaacgaaactaaagacgaaacgcgtacgagaacggacgaacggacgaaccgtcgtacgtagtttacgtacgttacgnggtaacggacgtaacggagtacgtaattaacgttcgtaccgtaaccggtaacccgtgttacgtttacg

SEQ ID NO: 344759 - DNA, 559 bp, Homo sapiens
  misc_feature: GZ8MTXP02IWDPB.11.27.C05.1.454.CMB.2.raw
  modified_base (521)..(521): a, c, t, g, unknown or other
  misc_feature (521)..(521): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagttagttatagcatgaactgggtccgccaggcctccgaggggaaggggctggaggtgggtctcatccattagtagtaaatagtcgacctacagtatactacgcagactcactgaagggccgactcaccatcctccaagacgacaacgaccaaagaactcactgtatctagacaaatcgaacagccgtagagacgaccggaggtaacgacggtctaggtgttaattacgtggtagcggagaaggngaacttattactccgtacggaccccgtagtcgtttacg

SEQ ID NO: 344760 - DNA, 542 bp, Homo sapiens
  misc_feature: GZ8MTXP02I7RSE.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccaggggaaggggctggagtgggtctcatccattagtagtaatagtgcctacagatactacgcagactcacgtgaagggccgactcaccatctccagacgacaacgaccaaagaacctacactgtaatcctagacaaatgaacagcctagagagcgaggacacgctgtgtattacgtgtcgacgaggaacggagtaacgtatttactcgtacggaacccccgtatcgtttaccg

SEQ ID NO: 344761 - DNA, 623 bp, Homo sapiens
  misc_feature: GZ8MTXP02I0OE8.11.27.C05.1.454.CMB.2.raw
  modified_base (257)..(257): a, c, t, g, unknown or other
  misc_feature (257)..(257): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgcttattttagaaggtgtccagtgtgaggtgcagctggtggagtcggtgggggaggcctggtcaagccggtgggggtccctgagctctcctgcgcngcctctgtattcaccttcagtagttatagcatagaacgtcgggtcccgccgaggcctccggaaggggacggggcgtagggaggtcgggtctcgactacctaagttagtaagtaaatagtacgacctagagtactactacgacacgactacgaacgtaggaaccggcccgactaccaacctactccctacgaagacgaaaccaaaccgacccaaagaacctacacttagtactacgtagaacaaatacgaacacgaccgtaggacgacgacggagaccgagtctagtatatacgtagtacggacgtaagagggtactaacgtttaagttaccgtaccgtaaccgggaacccttgttacgttttaacg

SEQ ID NO: 344762 - DNA, 521 bp, Homo sapiens
  misc_feature: GZ8MTXP02FGMPA.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcacccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgcaggctccaggggaaggggctggagtggggtctcgatccattagtagtaaatagtgcctacagatactacgcagactcactgaagggccgactcaccatctccagagacaacgccaagaactcactgtatctgcaaaatgaaacagcctgagagccgaggacacggctgtgtattactgtcgcgagaggtagctattactactcggaaccccgatcgttcg

SEQ ID NO: 344763 - DNA, 649 bp, Homo sapiens
  misc_feature: GZ8MTXP02HPJT8.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggattccaccttcagtagttatagcatgaacgtcgggtccgccaggcctccgaaggggaaggggctgggaggtggggtctcgactcctaattagtaagtaaatagtccgacctacagtaactactacgcacgactacacgtacggaacggggcccactacccacctacttccaccaagacgaaccaaaccgaccaaagaacctcacctagtaactcctagactaaaagtcgaaacacgtccaggaacgacggacccggaaggtaccgaccgggtacgttacgttagttaaaccgtttacgttggtacggacggaaggaaggtacgtaaccgttagtttacttaccggtaaccggtaaacccccggtagtttacggtttttaccgg

SEQ ID NO: 344764 - DNA, 580 bp, Homo sapiens
  misc_feature: GZ8MTXP02GHTZT.11.27.C05.1.454.CMB.2.raw
  modified_base (303)..(303): a, c, t, g, unknown or other
  misc_feature (303)..(303): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggattccaccttcagtagttatagcatgaactgggtccnccgaggctccgaggggaaggggctggagtgggtctcgatcctaattagtaagtaaatagtcgacctacaagactactaccgcagactcacgtgaacgggcccactcaccatcctaccagacgaacaacgccaaagactcactgaatctagaacaaatcgaaacacgccctaggacgacggacccgaggaaccgtacgggctacggttagtaatttacgtgtaggcgaaggagtagaattaacgttactaccgtacgggaacccctagttcgtttacg

SEQ ID NO: 344765 - DNA, 597 bp, Homo sapiens
  misc_feature: GZ8MTXP02IVOPR.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatagaacgtcgggtcccgccgaggcctccgaaggggaaggggctggaggtgggtctcatctattagtagtaatagtcgacctacagtactactacgcacgtactacacgtaggaacggggccgactcaaccctatcctacagaacgaccaaacgccaaagacctacactgtactctacgactaaatacggaaacacgacccgtaggacgacggacccggaaggaccgaacggtcgtaggtacgttattacgtggtacgacgacggaggagtcttaattactacgacggtaaaccccgtgttcgttttacg

SEQ ID NO: 344766 - DNA, 645 bp, Homo sapiens
  misc_feature: GZ8MTXP02H4FDC.11.27.C05.1.454.CMB.2.raw
  modified_base (390)..(390): a, c, t, g, unknown or other
  misc_feature (390)..(390): n is a, c, g, or t
  modified_base (432)..(432): a, c, t, g, unknown or other
  misc_feature (432)..(432): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctggtcaagccgtgggggtccctgagactctcctgcgcagcctcgtggtattccacccttcagttagttatagacatagaacgtgggtcccgccgaggcctaccggaggggaggggcgtggggaggttggggtcctacattacctagtttagtaagtaaatagtcgacctanagtactactacgcagactcacgtagaacgggccactcaccanctcagacaacaacgaccaagactcactgtactactagaacctaaatacgaaacgacgaccgtaggaacggacggaccggaacgggaaccgacggggtacgttaggttacggtttaaactttacgtgggttacggaccgggtaaacgaggggaactaacgttaacgtttaacgtaccggtaaccgggtaaaacccccgttgtttaccggtttcg

SEQ ID NO: 344767 - DNA, 544 bp, Homo sapiens
  misc_feature: GZ8MTXP02FNAB4.11.27.C05.1.454.CMB.2.raw
  modified_base (301)..(301): a, c, t, g, unknown or other
  misc_feature (301)..(301): n is a, c, g, or t
  modified_base (413)..(413): a, c, t, g, unknown or other
  misc_feature (413)..(413): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgagggaaggggctggagtgggtctcatccattagtagtaatagtcgacctacagatactacgcagactcactgaacgggccgactccaccatcctaccaaganaccaacgccaaagaactcactgtatctagacaaatggaaacagcctagaagcgaccgaaggacgacggctgtagtattacgtgtagcgaagaggagtcgtaagttactcgtacgaacccgatcggtttacg

SEQ ID NO: 344768 - DNA, 557 bp, Homo sapiens
  misc_feature: GZ8MTXP02G1DVR.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcaccttcagtagtatagcatgaactggtccgccaggctccgaggggaaggggctggagtgggtctcatccattagtagtaatagtcgcctacagatacacgcagactcactgaagggccgactccaccatctccaagacgaccaaacgccaaagaactccacgtgtaactctagaactaaaagtacgaaacagccctaggacggacgccgaggaccacgggtctacggtagttattactggtgccgaagaggagaacttattagtacctacggaaccccagttcgttacg

SEQ ID NO: 344769 - DNA, 701 bp, Homo sapiens
  misc_feature: GZ8MTXP02H4GZT.11.27.C05.1.454.CMB.2.raw
  modified_base (250)..(250): a, c, t, g, unknown or other
  misc_feature (250)..(250): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagcgtggtggagtcgtgggggagcctggtcaagccgtgggggtcctgagactctcngcgcacgcctcgtggacttccaccttcgagtagttatagctatacgaacgtcgggtcccgccgaggcctaccggaaggggaaggggcgtagggaggttcgggtcctcgactccgtaagtttaaagtaagtaaagtacggtcgacccgtaacagaacttaacgaccgtacagtacctacgacgttagggaaaccggcccgtaacctaccaaccctacgtacctaccgaacgaacgaaacccaaaccgaacccaaacgtaacctaccacgttacgacttacttacgaactaaaagtacgaaacgtacgacgtacggaacgaccggaaccggaaccggaccgtaccgggtccgttaggttaacgtttacgttaccgttaggtaccggacggaacggagggtacgtaacgttaacgttacgtaccgtaccggtaacccccgtagtttcgtttacg

SEQ ID NO: 344770 - DNA, 577 bp, Homo sapiens
  misc_feature: GZ8MTXP02GRH5Z.11.27.C05.1.454.CMB.2.raw
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
  modified_base (524)..(524): a, c, t, g, unknown or other
  misc_feature (524)..(524): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctatttagaaggtgtccagtgtgaggtgcagctggtggagtcgtgggggaggcctggtcaagccgtggggggtccctgagactctcctgcgcagcctctggattcaccttcagttagttatagcatgaactgggtccnccaggctccgagggaggggctggagtgggtctnatcctattagtagtaatgtcgcctanagatactacgcagactcacgtggaacggggccactcaccntccaccagacacaacgaccaaagacctcaactgtaatcctaagactaaaatcgaaactacgcctaggaggacgaccggaaggaccgacgggtcttagtgttaattacgttggcgaccggtaaggnggtaacgtcttaagttacgtccgttacggaaccccgttagttacgttttaccg

SEQ ID NO: 344771 - DNA, 551 bp, Homo sapiens
  misc_feature: GZ8MTXP02HUE3A.11.27.C05.1.454.CMB.2.raw
  modified_base (376)..(376): a, c, t, g, unknown or other
  misc_feature (376)..(376): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtgggtctcgatccattagtagtaaatagtcgacctacagatactacgnagactcactgaacgggccgactccaccatcctacagagacaaccgaccaaagactcactagtatctgactaaatgaacacgccagagacggcgaacggacgtacgcgtgtagtattactggtagacgagaggacgaagttacgtactacgtacggaaccccgtagttcgtttacg

SEQ ID NO: 344772 - DNA, 578 bp, Homo sapiens
  misc_feature: GZ8MTXP02HTDXD.11.27.C05.1.454.CMB.2.raw
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggtattcaccttcagtagttatagcatgaactgggtccgccaggcctccgaggggaaggggctggagtggggtctcatccattagtagtaaatagtcgacctacagactactacgcagactcaactgaaacggggccaactccaaccactcctccaagacgaacaaaccgaccaaagaactcactgtatcctagacaaaatagaaacagacctggacgagacccggaaggaccgaacgggctcgtaggttattacnggtggacgagaagggagaacgttaattacgcgttaccggaacccccgaagttcgtttcg

SEQ ID NO: 344773 - DNA, 538 bp, Homo sapiens
  misc_feature: GZ8MTXP02JA9M9.11.27.C05.1.454.CMB.2.raw
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgcgcagcctctggattcaccttcagtagttatagcatgaactgggtccnccaggctccgagggaaggggctggagtgggtctcgatccattagtagtaatgtgcctanagatactacgcagactcactagaacggggccactcacccatctccaagacacaacgcccaaagtaacctcgactgtactctgactaaatgaacacgacctgaagcgaccgaggacacgggctgtgttaagtctggtacgcgtagaggagctattactcgacggtacccagtcgtttacg

SEQ ID NO: 344774 - DNA, 598 bp, Homo sapiens
  misc_feature: GZ8MTXP02HOXRS.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattcaccttcagtagttatagcatgaactgggtccgccaggctccgaggggaaggggctggagtgggtctcgatccattagtaagtaaatagtcgaccttacagtaactactacgcagacctcaacgtcggaacggggcccgaactccgaacctatccctacaagagaaccaaacgaccaaagaactcactgtatctagactaaatagaacacgcctagacgacggccggaagacgacggcttagtagttaattacgtaggtcgacggacggaaggtacggtaacttacgttattacccggtaacgggaacccccgtagtttcgttttaccg

SEQ ID NO: 344775 - DNA, 528 bp, Homo sapiens
  misc_feature: GZ8MTXP02FWC9L.11.27.C05.1.454.CMB.2.raw
  modified_base (448)..(448): a, c, t, g, unknown or other
  misc_feature (448)..(448): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagcctggggggtccctgagactctcctgcgcagcctctggattcaccttcagtagttatagcatgaactgggtccgccaggctccgaggggaaggggctggagtgggtctcatccattagtagtaaatagtgcctacagatactacgcagctcacgtagaagggccgactcacccatcctccagacgacaaacgccaaagaactcactgtaatctgacaaatnaaacagcctagagacgcgagacacgctgtgtattactgtcgacgagaggagctattactcgacgaacccgtatcgtttcg

SEQ ID NO: 344776 - DNA, 600 bp, Homo sapiens
  misc_feature: GZ8MTXP02FWNSN.11.27.C05.1.454.CMB.2.raw
  modified_base (518)..(518): a, c, t, g, unknown or other
  misc_feature (518)..(518): n is a, c, g, or t
  modified_base (536)..(536): a, c, t, g, unknown or other
  misc_feature (536)..(536): n is a, c, g, or t
  modified_base (589)..(589): a, c, t, g, unknown or other
  misc_feature (589)..(589): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtgggagtcgtgggggaggcctggtcaagccgtggggggtccctgagactctcctgcgcagcctctggattcaccttcagtagttatagcatgaactgggtccgccaggctccgagggaaggggctggagtgggtctcatcctattagtagtaaatagtcgcctacagatactacgcagactcactacggaagggaccgactaccaaccatcctaccaagaacgaccaaaccgacctaaaagaacctcaaactggttaactctacgaacaaaatcgaaaaccagacccgaggaagaccggaccgaaggtaaccgacggtntaggttattaacttacgnggtagacggaaggacggagtaacgtttaatactccggaccggtaaaccccgtnttcggtttacg

SEQ ID NO: 344777 - DNA, 578 bp, Homo sapiens
  misc_feature: GZ8MTXP02HTCXS.11.27.C05.1.454.CMB.2.raw
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcacccttcagtagttatagcatgaacgtgggtccgccgaggctccgaggggaaggggctggagtgggtctcatccattagtagtaatagtcgcctacganatactacgcagactcactgaagggccgactcaccatcctacagagacaacgaccaaagactcactagtatctgactaaaatgaacacgcctagaaggacgaccggaaggaccgagggtacgtcggttagttacgttacgtaggttcggacgggaaggagggagtcgttaattacgttccggaccggtaaacccccgtgttacgttttcgg

SEQ ID NO: 344778 - DNA, 564 bp, Homo sapiens
  misc_feature: GZ8MTXP02F3JOY.11.27.C05.1.454.CMB.2.raw
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (448)..(448): a, c, t, g, unknown or other
  misc_feature (448)..(448): n is a, c, g, or t
  modified_base (464)..(464): a, c, t, g, unknown or other
  misc_feature (464)..(464): n is a, c, g, or t
  modified_base (497)..(497): a, c, t, g, unknown or other
  misc_feature (497)..(497): n is a, c, g, or t
  modified_base (510)..(510): a, c, t, g, unknown or other
  misc_feature (510)..(510): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctgtgattccaccttcagttagttatagcatgacgtggtccncaggctccggaagggacggctggaggtggtctcatcctattaagagtatagtcgacctacagtactactacgnacgtacncgaagtcggaacgggcccactccaacccattccaccgaagacgaaccaaccgacaacgtaactcacgtntaactgtacactaaanacgacacgacgaggacgacgacgagtacgcgtnttagtagtactgngacgacggagagtactaacttacgtacgtaccgaccgtacctagttcgtttacg

SEQ ID NO: 344779 - DNA, 590 bp, Homo sapiens
  misc_feature: GZ8MTXP02GNCAK.11.27.C05.1.454.CMB.2.raw
  modified_base (447)..(447): a, c, t, g, unknown or other
  misc_feature (447)..(447): n is a, c, g, or t
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccgccaggctccgaggggagggctggagtgggtctcatccattagtagtaaatagtcgcctacagactactaacgcagactcacgtagaacggggcccactccaacctatcctaccaagacgaaccaaacgccaaagaactcactgtaanctagacaaaatgaaacagaccctaggacgacgacccggaaggtaaccgacggtctaggtgttaaactttcgnggtacgacggaaggtacggaagtaacgtttaattacgtaccgtaaccggggaaaacccctgtcgtttaccg

SEQ ID NO: 344780 - DNA, 625 bp, Homo sapiens
  misc_feature: GZ8MTXP02IMRBN.11.27.C05.1.454.CMB.2.raw
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtctggggggaggcctggtcaagccgtggggggtccctgagactctcctgcgcagcctctggattcaccttcagtagttatagcatgaactgggtccgccaggctccgaggggagggcgtggagtgggtctcagtccattagtagtaatgtgcctananatactacgcngactcactgaacgggcactcaccancctcagacgacaacgccaaagactacactgtaatcctagacctaaatcgaaactagccccgtaggaacgacggaccggaaggaacccgacggggacctttagggtgtttaaacgttaccgttagggtacggtaccgggtaaaagggaccggttaaaggtaacccgtttaaatttaccgttaccgtaaaccgggggtaacccccctttaagtttcggttttaacccgg

SEQ ID NO: 344781 - DNA, 543 bp, Homo sapiens
  misc_feature: GZ8MTXP02IMVMI.11.27.C05.1.454.CMB.2.raw
  modified_base (333)..(333): a, c, t, g, unknown or other
  misc_feature (333)..(333): n is a, c, g, or t
  modified_base (497)..(497): a, c, t, g, unknown or other
  misc_feature (497)..(497): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgccaggctccgagggaggggctggagtgggtctcntccattagtagtaatagtgcctacagatactaccgcagactcactgaagggccgactcaccatcctccagacgaacaacgcccaaagaactcactgtatctgaccaaatacggaacacgcctagagacgccgaggacgcggctgtgtattcgtagtcgcgaagngggtagcgttaattacgtccgtacgggaaccccgagtgttttaccg

SEQ ID NO: 344782 - DNA, 524 bp, Homo sapiens
  misc_feature: GZ8MTXP02F1WLV.11.27.C05.1.454.CMB.2.raw
  modified_base (480)..(480): a, c, t, g, unknown or other
  misc_feature (480)..(480): n is a, c, g, or t
  modified_base (519)..(519): a, c, t, g, unknown or other
  misc_feature (519)..(519): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcatctggattcaccttcagtagttatagcatgaactgggtccgccaggctccaggggaaggggctggagtgggtctcatccattagtagtaatagtgcctacagatactacgcagactcactgaacgggccactcaccatctaccagagacaacgaccaaagactacactagtatctgacaaatgaacagcctgacgagccgaggacacggctgtgtacttacngtcgacgagaggaagtctattacgtctacggaaccccgnttacg

SEQ ID NO: 344783 - DNA, 622 bp, Homo sapiens
  misc_feature: GZ8MTXP02JZZDS.11.27.C05.1.454.CMB.2.raw
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
  modified_base (503)..(503): a, c, t, g, unknown or other
  misc_feature (503)..(503): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtcccgccacggcctccggaaggggaacggggcgtggaggtgggtcctacgactcctagttaagtaagtaaagtagtccgtacctanaagtactacacgtacncgaccactacgtaggaacggggccacgtaccaaccctatccctaccgaaggacaaaccgacgaccaaagaactcactgtactcgtacgactaaagtcgaaacncgccgtaggaagacggaccggaggtaccgacggtacttgggtattaacgtacgtgtacgcggaaagggacggtactaagtttaactacggtacgtaccggaacccgtgtcggttttacg

SEQ ID NO: 344784 - DNA, 605 bp, Homo sapiens
  misc_feature: GZ8MTXP02GQUQE.11.27.C05.1.454.CMB.2.raw
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccnccaggcctccgaggggaaggggctggagtgggtctcatccattagtagtaatagtcgacctanagatactacgcagactcacgtgaacgggcccgactccaacccatcctacccaagacgaaccaaccgaccaaagaacctcactgtaactctagactaaatgaaaccagaccctagacgacgaccggaggaccgacggtcttaggtacgttatttaccgtggtacggacgaaaggaggtaacgtaacgtttaaactttacgtacccgtaaccgggtaaacccccgtagtttacgttttacgg

SEQ ID NO: 344785 - DNA, 881 bp, Homo sapiens
  misc_feature: GZ8MTXP02JBXM7.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagccgtggtacaacgccggtcgggggtccctggacgtactcctccgtgccgcacgtcctcgtggtacttcctacccttactagtagttaatagactagtacgaacgtcggggtccccgacgacggtccgtaccggaagggggaacggggcgtaggggtaggtggggtcctacgtacgtacctaaagtttaaggttaaagtaaattacggtaccgaccctacaagtaacttaaccgtaacgacgacggtaaccctacgtaaaccggttacggggaaaccgggggacccgtaaaccccgttaccaaaacccccgtactttaccccggtaacccgaaaacgggaaaccgggaaaaccccttaaaacccccgggaaccccaaaaaacggtaaaccccctttaacggaaaccctttaggttaaaccgtttcctaaacggaaaacctttaaaagtacgaaaacccggaacgttacccggtaagggaaacggaaacccgggttaccgggaaaacgggacccccgtagggtaaccgttcggggttaaacttttaaagttaccgttagggttaccggacgggttaaaaggggacggtaaacggttaacgttttaaactttaaaccggtaccgttaaaaccccgggggtaaaaccccttcggtttacggtttttaccg

SEQ ID NO: 344786 - DNA, 634 bp, Homo sapiens
  misc_feature: GZ8MTXP02GTTO4.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggattcaccttcagttagttatagcatgactgggtccgcaggctccggagggaggggctggagtgggtctcgatccgtattaagtagtaaatgtacgcctacagactactacgcagacctcaacgtggaaacgggcccgaactccaaaccctattcccgaccgaaggaacgaacccgaaacccggaccctaaaacgaaacctcaaacttgttaaacctgtagaacctaaaatacggaaacacggaccctaggaacggacgaccgggaagtaccgacggtcgtaggttattacttacgtggtacgacggaggaaggtataaccttaaagttacgtacccgtaaccggaaacccccgtgttaacgttttccg

SEQ ID NO: 344787 - DNA, 641 bp, Homo sapiens
  misc_feature: GZ8MTXP02G9JF7.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgcccagtgtgaggtgcagctggtggagtcgtgggggaggcctggtcaagccgtggggggtccctgagactctcctgcgcagcctctggattcaccttcagtagttatagcatgaacgtggggtcccgccgaggcctccggaggggaacggggctggggagtggggtctcatcctattaagtagtaatagtcgacctacagactactacgcacgactcacgtggaacgggccgactccaaccatcctaccaaggaacgaaccaaaccgaccaaagtaacctcactagtactcctagacaaatagaaaccgtagcccgtagaacggtacggacccggaggaacccgtcgggtaccttaggttacgtttaactttaaccgttgggtaaggaccggaacggaagggtacggtaacctttaaagtttacgtccggtaaccggtaaccccgttagttcggttttaacccg

SEQ ID NO: 344788 - DNA, 555 bp, Homo sapiens
  misc_feature: GZ8MTXP02GIE70.11.27.C05.1.454.CMB.2.raw
  modified_base (462)..(462): a, c, t, g, unknown or other
  misc_feature (462)..(462): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtcctgagactctcctgcgcagcctctggattcaccttcagtagttaatagcatgaacgtgggtccgccaggctccgaggggaagggctggagtgggtctcatcctattagtagtaatagtgcctacagatactacgcagacctcactagaagggccactcaccatcctcaagagaaccaacgaccaaagaactacactgtaatctagaacaaagtagaacagaccngaacgagccggagacacggctcgtgttattacgtggtacgcgaaggaggacgaagttaattacgtacgtacggaaccccgtagtcgtttaacg

SEQ ID NO: 344789 - DNA, 611 bp, Homo sapiens
  misc_feature: GZ8MTXP02I60QA.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggtttccttgttgctatttagaaggtgtccagtgtgaggtgcagctggtggagtcggtgggggaggcctggtcgaagccggtgggggtccctgagactctcctgcgcacgcctcgtggacttcctaccttcagtagttatagcatagaacgtcgggtcccgaccgaggccgtaccggaggggaaggggcgtgggaggtgggtcctcacgtcctagttaagtaagtaatagtcgacctacagaatactacgcagactacacgtacgacggccgactacaccgtattcccacaacgacgaacctaaacgacccaaaagtaccctactaactctactcgtaccgaataaagtacgaacctagcccgtagaacgacgacccggagtaccgacgtctagtacgtatacgtgacggtacgaagaggtctaacgttattacgtacggtaccggtaaccctgttactttcgg

SEQ ID NO: 344790 - DNA, 610 bp, Homo sapiens
  misc_feature: GZ8MTXP02H0CGK.11.27.C05.1.454.CMB.2.raw
  modified_base (299)..(299): a, c, t, g, unknown or other
  misc_feature (299)..(299): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggagcctggtcaagccgtggggggtccctgagactctcctgcgcagcctctggattcaccttcagtagttatagcatgaactgggtccnccaggctccgaggggaagggctggagtgggtctcatccattagtagtaatagtcgacctacagatacgtacgcagactcacgtggaacggccgactccaccatcctaccagacaacaaccgaccaaagaacctcgactagtatcgtgaactaaaatcgaaacagtcctaggaacgacggacccggaaaggaccgaacgggcttaggtacgtttaaatttaccgtggtacgacgggaaggtaacgggacgtaaccgtttaaatttaacgacccggttaaccgggaaacccccgttagtttaccggttttacg

SEQ ID NO: 344791 - DNA, 417 bp, Homo sapiens
  misc_feature: GZ8MTXP02FQJIT.11.27.C05.1.454.CMB.2.raw
  modified_base (412)..(412): a, c, t, g, unknown or other
  misc_feature (412)..(412): n is a, c, g, or t
  modified_base (414)..(417): a, c, t, g, unknown or other
  misc_feature (414)..(417): n is a, c, g, or t
tcagcgagagataccacgaccggtgctcgatttagacgcgatcgaaggggctggagtgggtctcatccattagtagtaatagtgcctacagatactacgcagactcactgaagggccgactcaccatctccagagacaacgccaagaactcactgtatctgcaaatgaacagcctgagagccgaggacacggctgtgtattactgtgcgagaggagctattatctggaaccccgatgcttttgatttctggggccaagggacaatgctcaccgtctcttcagcctccaccaagggcccatcggtcttccccctggccaccctcctccaagagcacctccgtggggcacagccgccctgggctgcctggtcaaggactacttcgtatctctcgctgagcggctggcagcgcangnnnn

SEQ ID NO: 344792 - DNA, 622 bp, Homo sapiens
  misc_feature: GZ8MTXP02GIT56.11.27.C05.1.454.CMB.2.raw
  modified_base (301)..(301): a, c, t, g, unknown or other
  misc_feature (301)..(301): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctctggacttcaccttcagtagttatagcatgaactcgggtccnccaggctccgaggggaagggctggagtgggtctcatccatttagtagtaatagtcgacctacagaactactacgcagtacctcaacgtggaacggggcccactaccaccatcctacagacaacaaccgaccaaagaacctcactagtatctagaacctaaaatacgaaacgacgacccgtaggaacggacggacccggaaggaccgaacgggtccttaggttacgttaagtttaaccgtggtacggacggaacggaagggtacggtaacctttaagtttacgtaccggtaaccgggaacccccgttagtttcgttttacgg

SEQ ID NO: 344793 - DNA, 595 bp, Homo sapiens
  misc_feature: GZ8MTXP02G0NKN.11.27.C05.1.454.CMB.2.raw
  modified_base (301)..(301): a, c, t, g, unknown or other
  misc_feature (301)..(301): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgagggaggggctggagtgggtctcatccattagtagtaatagtcgacctacagatactacgcagactcactggaacggccgactccaccatcctaccagacgaacaacgaccaaagaactacactagtactctagacaaatcgaaacagacccgtgaacggacggccggaacggacgaaccgggcgttaggttacgttaactttaacgtggttacggacggaaggacggtaagtccgttaattacgtaccggtacgggaaacccccgttagttacgttttaccgg

SEQ ID NO: 344794 - DNA, 590 bp, Homo sapiens
  misc_feature: GZ8MTXP02H0UNH.11.27.C05.1.454.CMB.2.raw
  modified_base (283)..(283): a, c, t, g, unknown or other
  misc_feature (283)..(283): n is a, c, g, or t
  modified_base (323)..(323): a, c, t, g, unknown or other
  misc_feature (323)..(323): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactgggctcgctgggtttcctgttgctattttagaaggtgtcagtgtgaggtgcagctggtggagtcgtgggggagcctggtcaaggccgtggggggtccctgagactctcctgcgcagccctggacttcacctcctagtagtatagntatagagaggtcgcgacgcgcgacggagggaggtaggagnggtcggtctactacctatagtaagtaagtaagtagcctacagatactacacgacgactacacacgacgacggacaccacactacacacgacgaacgaaccgaacgaaacaaactaacaacctacgttacttagttaaacgtaaactaagaacgaacacgacgagacgacgacggacggacgtacgtagtagttacgtacgtagtacgacgacgacgacgtagtataacgtacgtacgtaccgtaacgtacgttacgtttacgttacg

SEQ ID NO: 344795 - DNA, 576 bp, Homo sapiens
  misc_feature: GZ8MTXP02FZIEZ.11.27.C05.1.454.CMB.2.raw
  modified_base (372)..(372): a, c, t, g, unknown or other
  misc_feature (372)..(372): n is a, c, g, or t
  modified_base (536)..(536): a, c, t, g, unknown or other
  misc_feature (536)..(536): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagttagttatagcatgaacgtgggtcccgccaggcctccggaaggggaaggggctggagtcgggtctcatcctaattagtagtaatagtcgacctanagtactactacgacagactcacgtgaacgggccgactcaccgatcctaccgagacgaacaaaccgccaaagaacctcactgtactcctagactaaagtacgaactagacccaggaacgacgaccggaggaccgacggtctagtgtattcgtgtacgcgtaaggngagtcgtaattactacgtacggaacccctgttacgtttcg

SEQ ID NO: 344796 - DNA, 599 bp, Homo sapiens
  misc_feature: GZ8MTXP02ITHTM.11.27.C05.1.454.CMB.2.raw
  modified_base (303)..(303): a, c, t, g, unknown or other
  misc_feature (303)..(303): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcacgcctctggattccaccttcagtattatagcatgaacgtgggtccncaggcctccgaggggaaggggcgtggaggtgggtctcgactccattagtagtaaatagtcgacctaacagactactacgcacgtactacacgtagaacggggccactccaacctactcctacgagacaaccgaacgaccaaacgtacctnactgtaactntacgaacttaanagaacagtaccagagacggacgaacggacacggcttaggtacttattacgttaggcggacggaagggtaggactaaccgttaattaacgttccggaaccgtaaccccgtgtttacgttttacgg

SEQ ID NO: 344797 - DNA, 558 bp, Homo sapiens
  misc_feature: GZ8MTXP02HGTFA.11.27.C05.1.454.CMB.2.raw
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgacgtcggtccgccgaggctccgaggggaacggggcgtgggaggtgggtctcatccattacgtagtaatagtcgacctanagatactacgcagactcacgtagaacgggccgactccaaccatcctccaganaaccaacgaccaaacgaactcactgtatctagactaaagtagaaacagccagaggacgcgagacgacggctagtgttattacgtgtacgcgaggaggagtcgttattacgtacgttacggaccccgtagtacgtttg

SEQ ID NO: 344798 - DNA, 614 bp, Homo sapiens
  misc_feature: GZ8MTXP02JEIPC.11.27.C05.1.454.CMB.2.raw
  modified_base (301)..(301): a, c, t, g, unknown or other
  misc_feature (301)..(301): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggaaggggctggagtgggtctcatcctattagtagtaatgtcgcctacagatactacgcagactcactaggaacgggccgactccaacctatcctacccaagacgaacaaccgacccaaagaacctcacctgtactctagacaaatacgaacacgccgtagaacgacggaccggaacggaccgacgggtcttaggtacgttaactttaacggtggtacggaccgggaaagggacggtaacgtaacgtttaacttaacgttccggtaacccgggtaacccccgtagtttccgtttttacgg

SEQ ID NO: 344799 - DNA, 625 bp, Homo sapiens
  misc_feature: GZ8MTXP02GV6UA.11.27.C05.1.454.CMB.2.raw
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
  modified_base (496)..(496): a, c, t, g, unknown or other
  misc_feature (496)..(496): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtggggggtccctgagactctcctgcgcagcctcgtgattcaccttcagtattatagcatgaacgtgggtccnccaggcctccgaggggaggctggagtggtctcatctattagtagtaatagtcgacctanagtactacgtacgcacgtactcgacgtaggaacgggcccgtaacncccaacctattcccacccaaaggaacgaaaccaaaccgacccgaaaacgtacctacacttcgtaactccgtaagactaaaagtcgaaacncgaccctaggaacgacggaccggagtaccgacggtctaggtacgttatttaccgaggtcggacggaaggtaggtaaccgtaatttaagttacgttaccgaaccggtaaccccgttagttcgttttacgg

SEQ ID NO: 344800 - DNA, 719 bp, Homo sapiens
  misc_feature: GZ8MTXP02IXH0F.11.27.C05.1.454.CMB.2.raw
  modified_base (261)..(261): a, c, t, g, unknown or other
  misc_feature (261)..(261): n is a, c, g, or t
  modified_base (626)..(626): a, c, t, g, unknown or other
  misc_feature (626)..(626): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctntggattcaccttcagttagttatagctagtagaaccgtcggggtccccgccgaggcctccggaaggggtaacggggcgtaggggaggttggggtcctacgacttcctaagtttaaggttaagtaaagttaggtaccgaccctaacagtaactaaccgtacgcacgtacctactaaccgtacggaacggggccctaaccgtcccaaacccgtatcccgtacccgaaaggaaccgaaacccgtaaacccgaacccaaaaggtaacccttacgaacccgtttagttaacctcgttaagaaactaaaagtacgaaaaccgacggtaccctagggaacggaccggtaccggaacgggaccgtaccgggtnttacggttagttaactttacggtggtaggcggaaacgagggtactaattaacgttacgtacccggtaccggtaaacccgtgttacggttttcg

SEQ ID NO: 344801 - DNA, 627 bp, Homo sapiens
  misc_feature: GZ8MTXP02JY01A.11.27.C05.1.454.CMB.2.raw
  modified_base (371)..(371): a, c, t, g, unknown or other
  misc_feature (371)..(371): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcaccttcagtagttatagcatgaacgtcgggtccgccaggcctccgaggggaaggggcgtggaggtgggtctcactccattagtaagtaatagtcgacctanagactactacgcagactcacgtagaacgggcccactaccacctatcccaccaagacaaccaaccgaccaaaagtaaccctcacgttgtaactctagacctaaagtcgaaacctgacccgtaggaacggacggaccggaacggtaccgacggggtccttaggttagttacgtttaccgtgggttggaacgagggtaccggtaaggtaactttaaacgttacgtcggtaacccgggaaccccgtagtttcgtttacgg

SEQ ID NO: 344802 - DNA, 634 bp, Homo sapiens
  misc_feature: GZ8MTXP02JYE21.11.27.C05.1.454.CMB.2.raw
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccgaggcctccgaggggaacggggctagggaggtggggtctcactccaattagtagtaaatagtcgcctanagtatactacgcagactcacgtagaacggggcccgaactccaaaccctatccctacccaaggacgaaccaaaccggcccaaaagtaacctcaacttggtaaacttcctagaacctaaaagtcgaaaaccacggtaccctagggaaacgacggacccggtaggaaccgacgggtcttacggttagttaactttacggtggtacgacggaaggacgggtataacgttatttacgccgttacgggaaccccgtattcggtttacg

SEQ ID NO: 344803 - DNA, 557 bp, Homo sapiens
  misc_feature: GZ8MTXP02JY0J6.11.27.C05.1.454.CMB.2.raw
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccaggctccgaggggaaggggcgtaggaggtgggtctcgactccattaagtagtaagtagtcgacctacagtaactactacgcagactacacgtagaacgggccgactcaccatcctacagacacaacgaccaaagaactcaactgtaatctagacaaatgaaacagcctagagacgacgacggacgacggntcggtatnttactggtacgcgagaggatcgtagttactacgtacggaaccccgtatcggtttacg

SEQ ID NO: 344804 - DNA, 541 bp, Homo sapiens
  misc_feature: GZ8MTXP02FPSFM.11.27.C05.1.454.CMB.2.raw
  modified_base (455)..(455): a, c, t, g, unknown or other
  misc_feature (455)..(455): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccaggctccgaggggaaggggctgggagtggggtctcatccattagagtaatagtgcctacagatactacgcagactcactgaacgggccgactcaacccatcctaccagagaaccaacgcccaaagaacctcactgtatctgacaaatgaaacngccctgagagaccggagacacggctgtagtattacgtgtgacgagaggatcgtaattacgtcgtacggaaccccgtgtacgtttcg

SEQ ID NO: 344805 - DNA, 650 bp, Homo sapiens
  misc_feature: GZ8MTXP02HVCMB.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccgaggctccgaggggaaggggcgtggagtgggtctcgatcctattagtagtaaatagtcgacctacagtactactaccgcagactcacgtagaaacggggccgactaccaccatcctaccagacgaaccaacgacccaaagaacctcaactgtaactctagactaaaatacgaaacacgacctaggacggacggacccggaaggaacccgacggtaccgttaggttacggtttaacgtttaccgtagggttacggacggtaaacggtaagggtacgtaaccgtttaagtttaacgttacccggtaaaccgggtaaaccccccggttagtttaccggtttttaaccgg

SEQ ID NO: 344806 - DNA, 672 bp, Homo sapiens
  misc_feature: GZ8MTXP02G846L.11.27.C05.1.454.CMB.2.raw
  modified_base (565)..(565): a, c, t, g, unknown or other
  misc_feature (565)..(565): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcacgcctctggattcaccttcaagtagttataggctagtacgtaacggtcgggtcccgccgacggtccgtaccggggaagggggtaggggccggtaggggtaagggttcgggtcttaccgtacgttaccgttaagtttaaagttaaagttaaagttaggtaccctaccgtaaacgagtaacttacgtacgacgacgtacctacgtacgtacggaccgggtaccgacctaccgactactaccctacgaaggaaccgaaacccaaccgaacgaaacaacctactagtacgttactcaagaactaaagcgaaanccgtacgaggacgacggaccgaggaccgtggtacttacggtattacgtacgtagcggacgacggtagactcttagtacctacggaaccggaccttagtacttttagg

SEQ ID NO: 344807 - DNA, 578 bp, Homo sapiens
  misc_feature: GZ8MTXP02IPWEN.11.27.C05.1.454.CMB.2.raw
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggacttcaccttcagtagttatagcatgaactgggtccnccgaggcctccgaggggaaggggctggagtgggtctcatccatagtagtaatagtcgcctacagtatactacgcncgactcactggaacggccgactccaacctnacctccagacgaccaaacgaccaaacgacctcacgtagtactcgtagaactaaatacgaaacacgcctagaacgacgacggaaggaccgacggtctaggtattacttacgtggtacgacggagagggactcgttaacttacgtccaacgggtacccctagttcgtttacg

SEQ ID NO: 344808 - DNA, 586 bp, Homo sapiens
  misc_feature: GZ8MTXP02GCE3H.11.27.C05.1.454.CMB.2.raw
  modified_base (303)..(303): a, c, t, g, unknown or other
  misc_feature (303)..(303): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagttagttatagcatgaacgtgggtccnccaggctccgaggggaggggctggagtgggtctcatcctattagtagtaatagtcgcctacagatactacgcagactcacgtggaacgggccgactcaaccatccctccaagacgaacaacgtccaaagaactcactgtaactctacgacaaaatgaaacagcctaggacggacgaccggaaggacgacgggtcttaggtacgttaattacgtggtacggaccggaaggcggaagtcctttaagttacgtaccgttaccggaaaccccgtgttcgttttaccg

SEQ ID NO: 344809 - DNA, 582 bp, Homo sapiens
  misc_feature: GZ8MTXP02I9XCD.11.27.C05.1.454.CMB.2.raw
  modified_base (375)..(375): a, c, t, g, unknown or other
  misc_feature (375)..(375): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtcgggtccgccgaggcctaccggaaggggaaggggcgtgggaggtgggtctcatcctagttagtagtaatagtcgacctanagatacgtacgcagactacacgtgaacgggaccgactcaccatcctacccgagacgaacaacgaccaaagacctcactgtactctagactaaancgaacanccgtagacgacgaccggaggacgacgtctaggtacgttattacgtggtacgacgtaacgaggactaacgttagtactacgtaccggtaacccgtgttacgtttacg

SEQ ID NO: 344810 - DNA, 573 bp, Homo sapiens
  misc_feature: GZ8MTXP02JXNE7.11.27.C05.1.454.CMB.2.raw
  modified_base (301)..(301): a, c, t, g, unknown or other
  misc_feature (301)..(301): n is a, c, g, or t
  modified_base (524)..(524): a, c, t, g, unknown or other
  misc_feature (524)..(524): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccncaggctcgagggaggggctggagtgggtctcgatccattagtagtaatgtcgcctacagatactacgcagactacacgtagaacggggcccgacctacccaccaattccctacccgaagacgaacccaaacgacccaaagaacctcaccttagtaaactctagacaaaatacggaacagccctaggacgacggccgaaggacaacgggctgtacgtattacgnggtcgacggagaggagtaactattaactcgtacgaccctatcgtttccg

SEQ ID NO: 344811 - DNA, 592 bp, Homo sapiens
  misc_feature: GZ8MTXP02JV7D3.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggcctccgaggggaaggggctggagtgggtctcatccattagtagtaatagtcgcctacagatactacgcagactcactagaacgggccgactccaccatcctccagacgaacaacgccaaagaacctcacctgtactctagactaaatacgaacgacgacccgtagacggacggaccggacggaccgacgggtcttggtacgttacttacgttggacggtacggaagggacggtacgtcgttaactttacgtaccgttaccgggaaacccccgtagttacggtttcg

SEQ ID NO: 344812 - DNA, 552 bp, Homo sapiens
  misc_feature: GZ8MTXP02IDNMM.11.27.C05.1.454.CMB.2.raw
  modified_base (260)..(260): a, c, t, g, unknown or other
  misc_feature (260)..(260): n is a, c, g, or t
  modified_base (360)..(360): a, c, t, g, unknown or other
  misc_feature (360)..(360): n is a, c, g, or t
  modified_base (425)..(425): a, c, t, g, unknown or other
  misc_feature (425)..(425): n is a, c, g, or t
  modified_base (546)..(546): a, c, t, g, unknown or other
  misc_feature (546)..(546): n is a, c, g, or t
tcagcgagagataccacgaccggtgctcgatttagacgcgatcgaagggtttggaggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcgcagcctntggattcaccttcagtagttatagcatgaactgggtcccgcgaggctccgaggggaaggggctggagtgggtctcatccattagagtaatagtgacctanagatactacgcagactcactggaacgggccgactcacactctccaagagacaacgacaaagaacncactgtaactctagacaaatcgaaacagcctaggacgacggcccgaaggaccaacggtctggttatactttacgcgtggacgtagaggaagtacttaagttacacgtccggaaaccccgtntttccg

SEQ ID NO: 344813 - DNA, 583 bp, Homo sapiens
  misc_feature: GZ8MTXP02JRJ4Y.11.27.C05.1.454.CMB.2.raw
  modified_base (324)..(324): a, c, t, g, unknown or other
  misc_feature (324)..(324): n is a, c, g, or t
  modified_base (540)..(540): a, c, t, g, unknown or other
  misc_feature (540)..(540): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcattacctatggcatgcactgggtccgcagactccaggcgaggggctggnggtgggtggctagttattcatatgatggaaatagtgacttctattcagtactccgtgaacgggccgattccaccgtcctacccgagtacgacaacttcccgaggtccaacacggcttaggtactcgtagactaaagtacggaaacaacgcccgtaggagacgacgtaggacggacgacgggtctggttagtacttacgtgtacgtacgtaaagttnttaccgttaagtaggtacggtacggacggttaacgggggtccg

SEQ ID NO: 344814 - DNA, 525 bp, Homo sapiens
  misc_feature: GZ8MTXP02FOY7U.11.27.C05.1.454.CMB.2.raw
  modified_base (372)..(372): a, c, t, g, unknown or other
  misc_feature (372)..(372): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagcctggggggtccctgagactctcctgcgcagcctctggattcaccttcagtagttatagcatgaactgggtccgccaggctccgagggaaggggctggagtgggtctcatccattagtagtaatagtgcctacagatactacgcngactcactgaagggccactcacatctcaganacaacgcaagaacncactgtatctgacaaatgaacagacctgagagacgaggacgacggctgtgtattacgtgtgcgaggaggagtaatacttataccgtcggaaaccccgatacggtttcg

SEQ ID NO: 344815 - DNA, 575 bp, Homo sapiens
  misc_feature: GZ8MTXP02HNRD5.11.27.C05.1.454.CMB.2.raw
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatagaacgtgggtccgccgaggctccgaggggaaggggcgtggaggtgggtctcactccattagtagtaatagtcgcctanagatactacgcagactacactggaacgggccgactccacctatcctacagacgaacaaccgaccaaagaactcactgtatctagactaaagtacgaaacgacgacctaggaacgacgccggaaggaccgtacggacgtgtagtattacgtgtacgcgaggaacggagtaacgttattactcgtacggaacccccgtagtcgtttacg

SEQ ID NO: 344816 - DNA, 556 bp, Homo sapiens
  misc_feature: GZ8MTXP02F27Z3.11.27.C05.1.454.CMB.2.raw
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (496)..(496): a, c, t, g, unknown or other
  misc_feature (496)..(496): n is a, c, g, or t
  modified_base (510)..(510): a, c, t, g, unknown or other
  misc_feature (510)..(510): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgcaggctccgagggaaggggctggagtgggtctnatccattagagtaatagtgcctacagatacacgcngactcactgaacgggccgactcaaccatcctaccagagacaaaccgccaaagaacctcaactgtatctagacaaatgaaacngacctgaacgngaccgaggactacgggctgttagatttacgtggtancggaagagggtaanccgttaaatttaacgtccgttacgggaaaacccccagttggtttcc

SEQ ID NO: 344817 - DNA, 564 bp, Homo sapiens
  misc_feature: GZ8MTXP02JSIY5.11.27.C05.1.454.CMB.2.raw
  modified_base (301)..(301): a, c, t, g, unknown or other
  misc_feature (301)..(301): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (401)..(402): a, c, t, g, unknown or other
  misc_feature (401)..(402): n is a, c, g, or t
  modified_base (411)..(411): a, c, t, g, unknown or other
  misc_feature (411)..(411): n is a, c, g, or t
  modified_base (469)..(469): a, c, t, g, unknown or other
  misc_feature (469)..(469): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggaaggggctggagtgggtctcgatcctagttacgtagtaatagtgacctacagactactacgnagactnactgaagggccatcacnnctaccaganacacgcaaagtactcatgtatccgtagaccaaagttcggaaacagaccctaggaacgnggacccgaagggaccgttacggcttggtagtacttacgttgacggcgaaggaggagcgttatttaacgcgtaccggaaaccctagtcggttttcg

SEQ ID NO: 344818 - DNA, 628 bp, Homo sapiens
  misc_feature: GZ8MTXP02HVJGO.11.27.C05.1.454.CMB.2.raw
  modified_base (383)..(383): a, c, t, g, unknown or other
  misc_feature (383)..(383): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtccctgagactctcctgcgcgacgcctcgtggatcaccttcagtagttatagcatgaacgtcgggtccgcgaggctccgaggggaggggcgtggaggtgggtctcatcctagttagttagtaatagtcgcctacagactactaccgncgactcacgtcggaacggaccgactccaccatctacgagacaacaacgaccaaacgtaactcactagttactctagaactaaataacgaacgaccgaccgtaggaacgacggaacccggaagggaaccgaacgggtcgtaggttacgtttaacttaccggttggttacgacggaacggaagggaacgtaacgtttaaagttacttaccggtaccgggtaaacccccgtaagtttcggttttaccg

SEQ ID NO: 344819 - DNA, 573 bp, Homo sapiens
  misc_feature: GZ8MTXP02JSJ22.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggattcaccttcagtagttatagcatgaactgggtccgccaggctccgaggggaaggggctggagtggggtctcatccattagtagtaatagtcgcctacagatactacgcagactcaccttaggaaacggggccgactacaccaacttcctaccagagaacaacgaccaaagaactacactcgtaatctagaccaaatggaaacagcctaggagacgaccggaggaccacgggctcggtagtattaacgtgtcggacgacggaggagtaaccgtattactcgtacggaacccccgtagtacgtttacg

SEQ ID NO: 344820 - DNA, 560 bp, Homo sapiens
  misc_feature: GZ8MTXP02G1P2C.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgcgcagcctctggattcacctttcagtagttatagcatgaactgggtccgccaggctccgaggggaaggggctggagtgggtctcatccattagtagtaaatagtcgcctacagactactacgcagactcactgaacgggccgactcaccatcctccagacgacaacgaccaagaactcactgtactctagactaaatgaaacacgcctaggaacgacgccgaaggaccgacggtctggtacgtattaccgtggtacgcgaagaggtagccttaattacgtacgtacggtaaccccgtagtcgtttacg

SEQ ID NO: 344821 - DNA, 565 bp, Homo sapiens
  misc_feature: GZ8MTXP02JCOO0.11.27.C05.1.454.CMB.2.raw
  modified_base (408)..(408): a, c, t, g, unknown or other
  misc_feature (408)..(408): n is a, c, g, or t
  modified_base (441)..(441): a, c, t, g, unknown or other
  misc_feature (441)..(441): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgaggggaaggggctggagtggggtctcgactcctattagtagtaaatagtcgcctacagtactactacgcagactcactggaacgggccactcacccntccacagacgacaacgccaagaactcactgtanctgacaaagtcgaactacgccgtagacgacgccgaaggaccgacggctaggtacgttattacgtggtacgcgagagggtaactccgtaattacgttccgacggtaaccccgtagttcgtttacg

SEQ ID NO: 344822 - DNA, 558 bp, Homo sapiens
  misc_feature: GZ8MTXP02FYFAJ.11.27.C05.1.454.CMB.2.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (548)..(548): a, c, t, g, unknown or other
  misc_feature (548)..(548): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttacttgttgctattttagaaggtgtccagtgtgaggtgcagctggtggagtcgtgggggaggcctggtcaagcctggggggtccctgagactctcctgcgcagcctctggattcaccttcagtagttatagcatgaactgggtccncaggctccgagggaggggctggagtggggtctcatcctattagtagtaaatagtcgcctanagatactacgcagactcacgtagaacggggccgactcaaccatcctacagagaccaaacgccaaagaactcaactgtactactgactaaatcgaaacagccctagagagcccgagtacacggctgtcgtaattacgtggtgacggtagaggacgaacgttattaacgtcctacgggaaaaccccgtnttcgtttacg

SEQ ID NO: 344823 - DNA, 532 bp, Homo sapiens
  misc_feature: GZ8MTXP02JIABB.11.27.C05.1.454.CMB.2.raw
  modified_base (353)..(353): a, c, t, g, unknown or other
  misc_feature (353)..(353): n is a, c, g, or t
  modified_base (369)..(370): a, c, t, g, unknown or other
  misc_feature (369)..(370): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctctgcgcagcctctggattcaccttcagtagttatagcatgaactggtccgccaggctccgaggggaggggctggagtgggtctcatccatagtagtaatagtcncctacagatactacgnngactcatgaaggccgacncaccatcncaganacacgccaagactcactgtatctgacaaatgaaacagccctagacgagaccgaggacacggctgtagttatactggtacgtacgaggaggagctaagttactaccgtacggaaccccgtagtacggtttcg

SEQ ID NO: 344824 - DNA, 635 bp, Homo sapiens
  misc_feature: GZ8MTXP02FXGLU.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtgggagtcgtgggggaggcctgggtcaagccgtggggggtccctgagactctcctgcgcagcctctggattcaccttcagtagttatagcatgaactgggtcccgccaggcctccggaggggaaggggcgtgggaggtgggtctcatcctattagtagtaaatagtcgcctacagatactacgcagacctcactaggaacgggacccactaccaccatcctaccaagacgaaccaaacgaccaaagaaacctcaaactgtaaatcctagaaccaaaagtcgaaaacagacccgtagaacggacgaccggaacgggaaccaccggggcttacggttagttaagtttaacgtggttacggaccggaaaggacgggtaaagtccgtttaaagtttaacgtaccgttaacccggggaaaccccctagtttcggtttaccg

SEQ ID NO: 344825 - DNA, 530 bp, Homo sapiens
  misc_feature: GZ8MTXP02FHEHQ.11.27.C05.1.454.CMB.2.raw
  modified_base (505)..(505): a, c, t, g, unknown or other
  misc_feature (505)..(505): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccgccaggctccgagggaggggctggagtgggtctcatccattagagtaatagtcgcctacagatactacgcagactcactgaaggccgactcaccatctaccagagacaacgcaaagaactcactgtatctagacaaatgaaacagaccctagacgacgccgaggacacggctgtagtattacgtgtcgcgaagaggagtctaattancgtacggaaccccgagtcgtttacg

SEQ ID NO: 344826 - DNA, 579 bp, Homo sapiens
  misc_feature: GZ8MTXP02GX3VZ.11.27.C05.1.454.CMB.2.raw
  modified_base (570)..(570): a, c, t, g, unknown or other
  misc_feature (570)..(570): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagttagttatagcatgaactgggtccgccaggcctcgagggaggggctggagtgggtctcatcctattagtagtaatagtcgtacctacagactaccgtacgcagacctacacgtagaacgggcccgactccaaccatcctacccagacaaccaaacgcccaaagactacactagtactctagacaaatagaacagacctggaacggcgaaccggaggaccgacggtcgtacggttagttacttacggtgtcggacggaggaggtataacttattaacgtcgaccggtaaaccctntcgttttcg

SEQ ID NO: 344827 - DNA, 549 bp, Homo sapiens
  misc_feature: GZ8MTXP02JSJ1R.11.27.C05.1.454.CMB.2.raw
  modified_base (301)..(301): a, c, t, g, unknown or other
  misc_feature (301)..(301): n is a, c, g, or t
  modified_base (445)..(445): a, c, t, g, unknown or other
  misc_feature (445)..(445): n is a, c, g, or t
  modified_base (526)..(526): a, c, t, g, unknown or other
  misc_feature (526)..(526): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccgagctccgaggggaaggggctggagtgggtctcatccattagtataatagtcgcctacagatactacgcagactcactgaaacgggccgactcaccactactacccagacgaacaaccgacccaaagaaacctcactgtaancctagacaaatagaaaccagacctgagacgccgaaggacgacggctggtagtattacgtgtgacgagagagaactattacncgtaggaacccctagtcgtttcg

SEQ ID NO: 344828 - DNA, 577 bp, Homo sapiens
  misc_feature: GZ8MTXP02F0DSR.11.27.C05.1.454.CMB.2.raw
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggtggagtcgtgggggaggcctggtcaagccgtgggggtccctgagactctcctgcgcagcctctggattcaccttcagtagttatagcatgaactgggtccgccgaggctccgaggggaaggggcgtgggaggtgggtctcgactccatttagtaagtaatagtnaccctacagatactacgcagctcactagaacggccgactccacactcnccaagacgacaacgaccaagaactcactgtaatctagaacaaatgaaacacggtcaggaagacgcccggggtaagaccacggtatgttagtaattacgtggtacgacggagtaggactattaattacgtaccgtaccgggtaaaccctagttcgttacgtttttag

SEQ ID NO: 344829 - DNA, 597 bp, Homo sapiens
  misc_feature: GZ8MTXP02JM5M3.11.27.C05.1.454.CMB.2.raw
  modified_base (380)..(380): a, c, t, g, unknown or other
  misc_feature (380)..(380): n is a, c, g, or t
  modified_base (556)..(556): a, c, t, g, unknown or other
  misc_feature (556)..(556): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccgaggcctaccgaggggaaggggcgtggagtgggtctcataccattaagtagtaaatagtcgcctacagaatacgtacncacgactcacgtagaacgggccgactacaccgatcctaccagacaaccaacgacccaaagaacctacgaactgtaaatcttagaaccaaattagaaacgacgaccgaggaagacggacccggaaggtaccgacggtaccgtaggttataacttacgtgttacggcgaggaacggangttaacttagaccgttacggaacccctaagtcggttttacg

SEQ ID NO: 344830 - DNA, 660 bp, Homo sapiens
  misc_feature: GZ8MTXP02G3TTZ.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgactggtccgcaggctccgagggaggggctggaggtgggtctcatcctattagtagtaatgtcgcctacagtatactacgacaggacctcacgtagaacgggcccgactaccacccatacccgtaccaaggaacgaaacccaaaacgaccccgaaaaggtaaacccttaccaaaccgttgttaaactccgttaacggaacctaaaagtcgggaaaaccacgtaccccgtaggaacggacggtaccggaaacgggaccaacggggtcgttaggttacgttaagtttaaccgtggtacggacggacgtacggggtaagtaaccttaagttacggttcgtaacccggtaaaccccgtaggtttcgttttaccgg

SEQ ID NO: 344831 - DNA, 652 bp, Homo sapiens
  misc_feature: GZ8MTXP02JS8NJ.11.27.C05.1.454.CMB.2.raw
  modified_base (380)..(380): a, c, t, g, unknown or other
  misc_feature (380)..(380): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaaggccgtggggggtccctgagactctcctgcgcagcctctgattcaccttcagtattatagcatgaacgtgggtccgccaggcctaccgaggggaaggggctagggagtgggtctacatcctattagtagtaatagtcacctacagactacacgnacgactacacgtagaacgggccactccaccatcctacagaacgacaaacgtacaaacgaactactactagtaactcctaagactaaaagtcgaaacagacccgtagaacggacggaaccggaacgggaacctaaacgggtccgttacgttagggttaaacctttaacggtcggttaaacggggacggtaaaacggtaacggtaacgttaacgtttaaacgttaaccgttaccggtaaacccggtaaacccccgttagtttaccggtttaacg

SEQ ID NO: 344832 - DNA, 597 bp, Homo sapiens
  misc_feature: GZ8MTXP02G0V3K.11.27.C05.1.454.CMB.2.raw
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
  modified_base (525)..(525): a, c, t, g, unknown or other
  misc_feature (525)..(525): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccnccaggctccgaggggaaggggctggagtgggtctcgatccattagtagtaatagtcgcctanagatactacgcagacctcactagaacgggccgactccgaacctatccctaccaagagaaccaaacgcccaaagaacctcactgtaactccgtagaactaaatcgaaacagcccgtagagacgacccggtagggaaccgacggtctagtacgtagtttaccnggttacgacggtaaggaggactcgtttaaagttacgtcggtaaccggaacccccgtagtttcggtttaaccg

SEQ ID NO: 344833 - DNA, 577 bp, Homo sapiens
  misc_feature: GZ8MTXP02I0LEG.11.27.C05.1.454.CMB.2.raw
  modified_base (466)..(466): a, c, t, g, unknown or other
  misc_feature (466)..(466): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcaccttcagtagttatagcatgaactgggtccgccaggctcgaggggaaggggctggagtgggtctcatccattagtagtaaatagtcgcctacagactactacgcagactcacgtagaacgggccgactccaaccatcctaccaagacgaccaacgccaaagaacctcactgtatctagaactaaatcgaaacacncccgtagaacgacggaccgaggtaacgacggcttagtacgttattacgtgacgacgaggtacggataaccgttaattaccgtcggtaaccggaacccctagtcgttttacg

SEQ ID NO: 344834 - DNA, 639 bp, Homo sapiens
  misc_feature: GZ8MTXP02H4UFB.11.27.C05.1.454.CMB.2.raw
  modified_base (287)..(287): a, c, t, g, unknown or other
  misc_feature (287)..(287): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtcctgagactctcctgcgcacgcctcgtggtattccaccttcagtagttanagcatgaacgtcgggtccgccgaggcctaccggaggggaaggggcgtggaggtgggtctcgatcctagttagtaagtaagtagtcgacctaacgagtaactactacgacacgaccttcaccgtagggaaccgggcctaccgtaccaccctactccctaccgaagaacgaaccaaccgaacccaaagaaccctctactagttactacgtcgaactaaactacgaacacgacgtaggacgaccggacggaacggacgacggtcgtgtacgttattacgtggtacggacggaaggtacggtagtaacttaacgttacgaccggttaaccggaaccccggttagtttacgtttcgg

SEQ ID NO: 344835 - DNA, 604 bp, Homo sapiens
  misc_feature: GZ8MTXP02HITLC.11.27.C05.1.454.CMB.2.raw
  modified_base (261)..(261): a, c, t, g, unknown or other
  misc_feature (261)..(261): n is a, c, g, or t
  modified_base (411)..(411): a, c, t, g, unknown or other
  misc_feature (411)..(411): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctntggattcaccttcagtagttatagcatgaactgggtccgccaggctccgaggggaaggggctggagtgggtctcgatccattagtagtaatagtcgacctacagaatactacgcacgactacactaggaacgggcccgactccaaccctntaccctcaagacgaacaacgaccaaagactacactgtatcctagactaaaatacgaaacagcccgtagaacggacgaccggaaggacgaacgggctttaggtagttaagtttaccgtaggtacggaccggaaaggggagacggttaacctaagtttacgtacgtaccgggtaacccctagtttcgttttacgg

SEQ ID NO: 344836 - DNA, 562 bp, Homo sapiens
  misc_feature: GZ8MTXP02HFCT0.11.27.C05.1.454.CMB.2.raw
  modified_base (436)..(436): a, c, t, g, unknown or other
  misc_feature (436)..(436): n is a, c, g, or t
  modified_base (489)..(489): a, c, t, g, unknown or other
  misc_feature (489)..(489): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggtggagtcgtgggggaggcctggtcaagccgtgggggtccctggagactctcctgcgcagcctctggattcaccttcagtagtatagcatgaacgtggtccgcaggctccgaggggaagggctggagtgggtctcgatcattagtaagtaatagtgccctacagatactacgcagctcactaggaacggccgactcaaccatctaccagacgaacaacgacaaagaactcactgtacnctagacaaatagaaacagcctagacgacggccggaaggacgacggctaggttntaattacgtagtcgacgacggacggagtactaagttactacgtaccggaacccctagttcgttacttttacgg

SEQ ID NO: 344837 - DNA, 624 bp, Homo sapiens
  misc_feature: GZ8MTXP02JR898.11.27.C05.1.454.CMB.2.raw
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtggggggtccctgagactctcctgcgcacgcctntgattcaccttcagtagttatagcatgaacgtcgggtccnccgaggctccggaaggggaaggggcgtggagtgggtctcatccattagtagtaatagtcgcctanagatacacgcagacctacacgtgaaacgggtcccgaactcccaaccactcctacccgaagaacgaacccaaaccgaccaaagaacctacacgtatactctagaactaaagtacgaaacacgaccgtaggaacgacggaccggaacggaccgacggcgttacgtacggttacttacgtaggtacggacggtacggaggaacgtaacgttaagttacgtacggtaccggtaaacccccgtaggttacgttttaccgg

SEQ ID NO: 344838 - DNA, 606 bp, Homo sapiens
  misc_feature: GZ8MTXP02JQCTA.11.27.C05.1.454.CMB.2.raw
  modified_base (301)..(301): a, c, t, g, unknown or other
  misc_feature (301)..(301): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgagggaggggctggagtgggtctcatccagttagtagtaatagtcgtcctacgagtactactacgacagtacctacacgtagggaacgggccgactaccaacccatccctaccaagacgaacccaaacgaccaaagaaccctcaccgtagtactccagaacctaaagtacgaacagacccgagaacggacgacggaggacgaacggcttacgtagttacttacgtggtacgacggaaggtacgggataacgttacttacgtacggtaacccgggaacccgtagttcgttttaccgg

SEQ ID NO: 344839 - DNA, 583 bp, Homo sapiens
  misc_feature: GZ8MTXP02JK88Q.11.27.C05.1.454.CMB.2.raw
  modified_base (482)..(482): a, c, t, g, unknown or other
  misc_feature (482)..(482): n is a, c, g, or t
  modified_base (526)..(526): a, c, t, g, unknown or other
  misc_feature (526)..(526): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaaggccgtggggggtccctgagactctcctgcgcacgcctctggattccaccttcagttagttatagcatgaacgtgggtccgccaggctccggaggggaggggctgggtagtgggtctcacgtcctaatttagtaagtaaattagtcgacctacagactacctacgcagacctacacgtacggaacggggcccactccaaccatccaccagacgaacaacgccaaagactcactgtactctagacaaagtcgaaacncgctaggacgacgacgaggtacacggtctagtacgttattacgnggtcgacggaggtagacgtcttaattacgtaccgtaccggaaccctagtcgtttacg

SEQ ID NO: 344840 - DNA, 597 bp, Homo sapiens
  misc_feature: GZ8MTXP02JE4O9.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagtagttatagcatgaactgggtccgccaggctccgaggggaggggctggagtgggtctcgatccattagtagtaatagtcgcctacagtatactacgcagctacactagaacgggccgactccaaccatcctacccaagacgaaccaaccgacccaaagaaccctcaacctgtaatctagactaaaagtcgaaacacgcctagaacggacggaccggaacggaccgacggtcgttaggttacgttaattacgtggtacggacggaaggtaggagtaacttaagtttacgtcgtaaccggaaccccgtagttcgttttacg

SEQ ID NO: 344841 - DNA, 549 bp, Homo sapiens
  misc_feature: GZ8MTXP02FMHIL.11.27.C05.1.454.CMB.2.raw
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagtagtatagcatgaactgggtccgcaggctccgaggggaaggggctggagtgggtctcgatccattagtagtaatagtcgcctacagatactacgcagactcacgtgaacgggccgactcaccatctaccaganacaacgccaaagacncactgtatctagacaaatgaaacngacctagacgagaccgaggaccgacgggctcgtagtaattctggtgaccggtagaggacgtccttaagttactacgtacggaaaaccccgtgtacgtttcg

SEQ ID NO: 344842 - DNA, 600 bp, Homo sapiens
  misc_feature: GZ8MTXP02G044M.11.27.C05.1.454.CMB.2.raw
  modified_base (301)..(301): a, c, t, g, unknown or other
  misc_feature (301)..(301): n is a, c, g, or t
  modified_base (422)..(422): a, c, t, g, unknown or other
  misc_feature (422)..(422): n is a, c, g, or t
  modified_base (545)..(545): a, c, t, g, unknown or other
  misc_feature (545)..(545): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggaagggctggagtgggtctcatcctattagtagtaaatagtcgacctacagatactacgcagactcactaggaacgggccgactaccaaccatcctaccgaaagganaaaccgaaacgcccaaaagaacccttacaacttagtaactcgtacgaactaaaagtacgaaaccaacgcccgtaaggaacggacgaccggaaggaccgaacgggtcttggtagttacttacgngtacggcgaaggtaggacgtcttaattacgtcgacgaacccctagttcgtttacg

SEQ ID NO: 344843 - DNA, 553 bp, Homo sapiens
  misc_feature: GZ8MTXP02J091D.11.27.C05.1.454.CMB.2.raw
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
  modified_base (541)..(541): a, c, t, g, unknown or other
  misc_feature (541)..(541): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggggctccgctgggttttccttgttgctattttagaaggtgtccagtgtgaggtgcagctggtggagtctgggggaggcctggtcaaagcctggggggtccctgagactctcctgcgcagcctctggtattcaccttcagtagttatagcatgaactgggtccnccaggctccgaggggaggggcgtggagtgggtctcatcctattagtagtaatgtcgcctacagatactacgcngactcacgtgaaggggccactcaccatcctcagagaaccaacgaccaaagaacctcaactgtatctagcaaagtgaaacngcctagacgngacccgggagaccgacgctgtagtattacgtggtcgacggagtagcgtaactatttacacgtacggaaaccccgtnttacggtttacg

SEQ ID NO: 344844 - DNA, 614 bp, Homo sapiens
  misc_feature: GZ8MTXP02IHCZ5.11.27.C05.1.454.CMB.2.raw
  modified_base (377)..(377): a, c, t, g, unknown or other
  misc_feature (377)..(377): n is a, c, g, or t
  modified_base (491)..(491): a, c, t, g, unknown or other
  misc_feature (491)..(491): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatagaacgtcgggtccgccgaggcctccgaaggggaaggggcgtagggaggtgggtctcactcctaattagtaagtaatagtcgacctanagatactacgacagactcactagaacgggccgactccaacctatccctaccagacgaaccaaaccgaccaaagaacctcacttagtaacttctacgaactaaaagtgaaaaccngacccaggaacgacggcccggaaggaccgacggctttagtacgttattacgtggtacgacggaagtaaggaactaactttaagttacgtcggaaacccggtaaccctagtttcccgttttacg

SEQ ID NO: 344845 - DNA, 592 bp, Homo sapiens
  misc_feature: GZ8MTXP02JQSJD.11.27.C05.1.454.CMB.2.raw
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
  modified_base (452)..(452): a, c, t, g, unknown or other
  misc_feature (452)..(452): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggaaggggctggaggtgggtctcatccattagtagtaaatagtcgacctacanagtactacgcagactcacgtgaagggccgactcaacccntcctccaagacgaaccaaacgacccaaagaacctcaactgttaaancttagactaaaatacgaaactacgcctagagacggaccgaggacacgggcttaggtcttattacgtgttggacggaaggaggacgtaaccgttaattacgtaccgtaaccgggtaaaaccccgtagttcgttttaaccgg

SEQ ID NO: 344846 - DNA, 686 bp, Homo sapiens
  misc_feature: GZ8MTXP02GJ6UO.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaaggccgtggggggtccctgagactctcctgcgcagcctctggattcaccttcagtagttatagcatgaacgtcgggtccgccgaggcctccgaaggggaaggggcgtgggaggtgggtcctcgactcctagttaagtaagtaaagttacggcgtacctaacagtaactactaacgacacgacctacaacgtacggaacgggcccactaccaccacttcccaccgaagaacgaacccgaaaacccgccgaaaacgtaaaccctctaacgtagttaactccgtaagaacctaaaagtacgaaacgacgtaacccgtggaaacggacggaaccggaagggaacccgtaccggcgttaggttacgttaaagtttaccgagggttacggccggaaagggaacgggtattaaccgttaatttaaccgtccggtaaccgggaaacccccgttagtttacggttttacg

SEQ ID NO: 344847 - DNA, 732 bp, Homo sapiens
  misc_feature: GZ8MTXP02FRAJM.11.27.C05.1.454.CMB.2.raw
  modified_base (583)..(583): a, c, t, g, unknown or other
  misc_feature (583)..(583): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtcctgagactctcctgcgcagcctctggattcaccttcagtagtatagcatagaacgtcgggtccgaccgaggcctaccggaagggggaaacggggtcgtaggggaggttggggttaccttacgacttaccctaaattttaaggtaaagttaaaattacggtaccgtacccttaaacgaagtaacttaaccgtaaccgactaacggacccttaccaaaccggttacgggaaacgggggtccccgaaacttacccaaacccattccctacccgaaagaacgaaaccaaacgacccaaaagtaaaccctcaaacttgtaaactctaagaactaaaagtacgaaaaccncgtacccaggaacgacgggacccggaaggaaccgacgggtacgttaggttacgttaattttaccggtggtacggacggaaacggacggtaacgtaacgtttaacgttaacgtacccggtaaaccggtaaacccgtagtttacgtttacg

SEQ ID NO: 344848 - DNA, 730 bp, Homo sapiens
  misc_feature: GZ8MTXP02I0E0F.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagtagttatagcatagaacgtcgggtcccgaccaggcctaccggaaggggaacggggcgtaggaggtgggtctacgatcctaagttaagtaagtaaatacgtacgaccctaagaagtaactaacgtacgacacggtacctacgtaacgtacggggaaccgggaccccgaacttacccgaaaccctacttacccgaacccgaaaggaaacgaaacccaaaacccggacccaaaaacggtaaccttacaaacgttaggttaacttaccgaagaaacctaaaagtaccgaaaacgtaccgacccgaggaacggacgaaccgggtacggaaccgaccggtacgtttaggtacgttaactttacggtaggtacccggtacggaaaaggtacgggaatttaaccgttaattaacgttacccggaaccccgggttaaaacccctgtttaccgttttaacgg

SEQ ID NO: 344849 - DNA, 647 bp, Homo sapiens
  misc_feature: GZ8MTXP02HXI4D.11.27.C05.1.454.CMB.2.raw
tcagcgagagataccacgaccggtgctcgatttagacgcgatcgaagggtttgggggagagaggagccttagccctggattccaaggccctatccacttggtgatcagcactgagcaccgaggattcaccatggaactggggctccgctgggttttccttgttgctattttagaaggtgtccagtgtgaggtgcagctggtggagtcgtggggggagcctgggtcaagccgtggggggtccctgagactctcctgcgcagcctctggtattccaccttcagtagttatagcatgaacgtgggtccgccgaggcctccgaggggaaggggcgtggagtgggtctcatccattagtagtaatagtcgacctacagtatactaacgcagactacactggaaacggccgactccaccatcctaccaagacgaaccaaccggacctaaagaaacctcacgtagtactctagaactaaaatacgaaacacgtaccaggaacggaacggacccggaaggtaccgaaaccgggtccgttacggtaggtttaacttaaccgttggttaggaccggaaacgggaggtaacgtaaccgtttaaagttaacgttaccggtaaccggtaaaccccccggtagtttaaccggtttttccgg

SEQ ID NO: 344850 - DNA, 541 bp, Homo sapiens
  misc_feature: GZ8MTXP02FWSL8.11.27.C05.1.454.CMB.2.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgagggaggggctggagtgggtctcatccattagtagtaatagtcgcctanagatactacgcagactcacgtggaacgggccgactcaaccatcctacagagaacacgaccaagaactcactgtatctgacaatnaacagcctagacgacgcgagacgacggtntcgtagtatcgtgtgacgtacgaggtacgtcttaagttacgtcgtacggaacccgtagttcgtttacg

SEQ ID NO: 344851 - DNA, 562 bp, Homo sapiens
  misc_feature: GZ8MTXP02FR3MI.11.27.C05.1.454.CMB.2.raw
  modified_base (435)..(435): a, c, t, g, unknown or other
  misc_feature (435)..(435): n is a, c, g, or t
  modified_base (554)..(554): a, c, t, g, unknown or other
  misc_feature (554)..(554): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaacgtgggtcccgccgaggcctccgaggggaacggggcgtggaggtgggtctcgatccattagagtaatagtcgcctacagatactacgcagctcactgaacggggccactccaccatcctccaagagaacaacgcccaaagaacncactgtatctgacaaatgaaacagcctaggacgacgaccggagggaacacgggctaggttatacgtttactggtagcgaagagggactcttaaattcgtacgtcgggaaaaccccgttnttcgttcg

SEQ ID NO: 344852 - DNA, 686 bp, Homo sapiens
  misc_feature: GZ8MTXP02JP2GP.11.27.C05.1.454.CMB.2.raw
  modified_base (464)..(464): a, c, t, g, unknown or other
  misc_feature (464)..(464): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggaggcctggtcaaggccgtgggggtccctgagactctcctgcgcagcctctggtattcaccttcagtagttatagctagtgaacgtcgggtccgccgaggcctccggaggggaaggggcgtagggaggttggggtcctcgtacgtacctaatttaacgtaagttaaacgttaggtcgtaccctaacgaaggtactaacctacggacacgtacctacaacgtacgggaacgggcccgtaactccaacccgtntaccctacgaaggaacaaccgaaaccgacccaaagtaaccctacgacgttagttaactcgtaaggaacctaaaagtacgaaaccgtagaccgtaggaacggaccggaccgggaacggaaccgtacggtcttaggttacgttagttaccggtggacgtacggaaggacggggtataacgttaagtttacgtaccggtaaccgtaaccccgtagttcgtttacg

SEQ ID NO: 344853 - DNA, 648 bp, Homo sapiens
  misc_feature: GZ8MTXP02JSYNK.11.27.C05.1.454.CMB.2.raw
  modified_base (306)..(306): a, c, t, g, unknown or other
  misc_feature (306)..(306): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggaggccgtggtcaaggccgtggggggtccctgagactctcctgcgcagcctctggattccaccttcagtagttatagcatgaactgggtccnccaggctccggaggggaggggctggaggtggtctcatccattagtagtaatagtcgcctacagaactactacgctacgactacacgttacggaacgggcccgaacctccaacccgtactaccctaccaacggaacgaaccaaaccgacccaaaacgaacctaactacctagttactaccgttacgaactaaagtacgaaacgacgaacccgtaggaacggacggacccggacgggaaccgaccgggtacttcggttagttagttaccgtaggttcgacggtagacggtacgtaacgtttaacgtacttacggttaccggtaaccccggtattcgttttaccg

SEQ ID NO: 344854 - DNA, 828 bp, Homo sapiens
  misc_feature: GZ8MTXP02FXBW3.11.27.C05.1.454.CMB.2.raw
  modified_base (304)..(304): a, c, t, g, unknown or other
  misc_feature (304)..(304): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagttagtatagcatcgaactgggtcccnccgaggcctccgaggggaaggggcctagggagttggggtctcgatacctaattaagtaacgtaaagtagtccgaccccgttaacgagtaacttaccgtaaccggacacggtaacctaccaaacgttacggggaaaccgggggacccctaaaccttacccaaccctaaatttccccgtaccccgaaaaggaaccgtaaaaccccgaaacccgaacccgaaaaacggtaaaccccttacaaacccgtttaggttaaaccgtttccccgaaggttaaaacccgaaaacttaccggggaaaaacctaccggaaccccggttaggggaaaaccgaccggggaaaccccgggttaggggaaaaccgaccccggggttcgtttacgggtttaggttaaacttttaaacccgggttggggttacgggtaaccgggaaacggggttaaggggaaaccgttaacgtttaaggttaaaccgtttacccgggtaacccgggtaaaacccccggttggtttaccggtttttaaccgg

SEQ ID NO: 344855 - DNA, 623 bp, Homo sapiens
  misc_feature: GZ8MTXP02H0MC1.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctggtttccttgttgctatttagaaggtgtccagtgtgaggtgcagctggtggagtcgtgggggagcctggtcaagccgtgggggtccctgagactctcctgcgcagcctctggtacttcaccttcagtagttatagcatagaacgtcgggtccgccgaggcctaccggaaggggaaggggccgtggggaggttggggtcctacactcctattaagtaagtaaatagtcgacctacagacttactacgcagactacacgtagaacggggccaactcacactcctacagacgacaaacgccaaagacacgtactgtaactctgaacctaaatacgaaacgacgacccgtaggaacggacgggaccgaacgggaaccgacgggtattacggtagttaacttacgtggtaggaccggtaggaacggtagtaacgtttaacttacgttacccgtaacggtaaccccgtagtccgttttacg

SEQ ID NO: 344856 - DNA, 589 bp, Homo sapiens
  misc_feature: GZ8MTXP02JY8XK.11.27.C05.1.454.CMB.2.raw
  modified_base (376)..(376): a, c, t, g, unknown or other
  misc_feature (376)..(376): n is a, c, g, or t
  modified_base (455)..(455): a, c, t, g, unknown or other
  misc_feature (455)..(455): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctgggtcaagccgtggggggtccctgagactctcctgcgcagcctctggattccaccttcagtagttatagcatgaactgggtccgccaggctccgaggggaaggggctggagtgggtctcatccattagtagtaatagtcgcctacagatactacgcngactcactggaacggggccactccacactctaccgacgagaaccaacgaccaaacgaactacactagtatactgaaacnccagaacgacgacgacgacggacggacggacggacgacggtcgtacggtagttagtacgtggtacggacggacgggaacggacgtaacgttacgttacgtaccggtaacccggtaacccgtacgttacgtttcg

SEQ ID NO: 344857 - DNA, 825 bp, Homo sapiens
  misc_feature: GZ8MTXP02J0AAC.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaacgccgtggggggtccctgagactcctcctgcgcacgcctcgtggtacttcctaccttcagttagttatagcatagaacgtcgggtccgccgaggcctaccggaaggggaggggtcgtaggggtaggtcggggtcctacgtacttacctaagtttaagtaagtaaacgtagtaccgtaccttaagagtaacttacctacgcacgacctaccgtaacgtacgggaaacggggccccgtaactacccaacctaccgttccaacccgaaagaacccgaaaaccgaaacccggtaaccctaaaacggtaaaccctaccgtaaaccgttacgttaaacctttccgtaacgaaacccgtaaaaagttaccggaaaaccgacggtacccgttaaggaaacgggtaaccggaacccgggaaacgggaaacccggtacggggtaacccgttgggtttaaacggtttaaacgtttaaaccggttcggttacggggtaaccgggaaaacgggtaaagggggttaaccggtaaccgtttaaaacggtttaccgtacccgggggttaaaaccccggaaaacccccggtttggtttacccgttttttaaaccggg

SEQ ID NO: 344858 - DNA, 584 bp, Homo sapiens
  misc_feature: GZ8MTXP02IATUW.11.27.C05.1.454.CMB.2.raw
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccaggcctccgaggggaaggggctggagtgggtctcatccattagtagtaatagtgcctacagatactacgcagactcactgaacgggccactcaccancctacagacgacaaacgccaaagacncgactgtactctagacaaaatcgaactagcctaggaacgacggcccggaaggaaccgacgggacttcggtagtttaattacgtggtcggacgacggtaaggacggctttaaacgttacgttaccgtaacgggaacccccgtaagtttacggttttcg

SEQ ID NO: 344859 - DNA, 670 bp, Homo sapiens
  misc_feature: GZ8MTXP02JMI1P.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctcgtggacttcctaccttcagtagttaatagcatagaacgtcgggtccccgccgacggcctccggaggggaacggggtcgtggggtaggtggggtctaccgtataccgtaagttaagtaagtaaagtagttcgacctaacagaattactacgaccagacctacaaccgtaggaacgggggacccaaacctcccaaaccctactcctacccgaaagaaccgaaccgaaacccgaccaaaacgacctacactagtaactcctaagaaccaaatacgaaactacgaccaggaacggacgacccggaggaacgacggtctacgtcgttaatacgtgtaggacggaaacggagggtaactccgttaagtttaacggtacccggtaaaccgggaaccccttaggttcgtttttacgg

SEQ ID NO: 344860 - DNA, 609 bp, Homo sapiens
  misc_feature: GZ8MTXP02F6K9Q.11.27.C05.1.454.CMB.2.raw
  modified_base (305)..(305): a, c, t, g, unknown or other
  misc_feature (305)..(305): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtcctgagactctcctgcgcagcctctggattcaccttcagttagttatagctatagaacgtcgggtcccnccgaggcctaccggaggggaagggcgtgggaggtgggtctcactcctagttagtagtaaatagtcgcctacagactactacgcagactcgacgtaggaacgggcccgactaccaacctatccctaccgaagacgaaacccaaaccgaccaaagaacctcaacgtgtaactctagaacaaaagtgaaacagccctaggacgacgaccggaagaccgacggtctaggtagttactacgtggtacgacgaaggacggtataacgttaacttacgtccggtaaccggtaacccgtgtttacgttttcg

SEQ ID NO: 344861 - DNA, 737 bp, Homo sapiens
  misc_feature: GZ8MTXP02JTD1M.11.27.C05.1.454.CMB.2.raw
  modified_base (687)..(687): a, c, t, g, unknown or other
  misc_feature (687)..(687): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggccgtggtcaagccgtgggggtccctgagactctcctgcgcagcctcgtggtacttccaccttcagtagttatagcatagaacgtcgggtcccgccgaggcctccggaggggaacggggcgtggggaggttcggggtctcgactacctagtttagtaagtaaagttagtccgtacctacgagtaactacgtaccgacacgtacctcgaacgtacgggaaccgggccgtaaccgtcccaaacccgtacttccccgtaaccaacggaaacccgaaacccgaaaacccgacccgaaaacgtaaccccttaccgtaacgtttagttaaaccttacgtaacggaaacaaaagttaccggaaaccgaccgtacccgtaggaacgggaaccggaacccgggaacggaacccggtacgggtccgtttaggttacgtttaacgttaccgttaggtacgggacggtaaggtacggtaaccgtntttaaacgttacgttaccgtaaccggtaccccgtagttcggttttaaccg

SEQ ID NO: 344862 - DNA, 675 bp, Homo sapiens
  misc_feature: GZ8MTXP02HOHGI.11.27.C05.1.454.CMB.2.raw
  modified_base (282)..(282): a, c, t, g, unknown or other
  misc_feature (282)..(282): n is a, c, g, or t
  modified_base (516)..(516): a, c, t, g, unknown or other
  misc_feature (516)..(516): n is a, c, g, or t
  modified_base (608)..(608): a, c, t, g, unknown or other
  misc_feature (608)..(608): n is a, c, g, or t
  modified_base (662)..(662): a, c, t, g, unknown or other
  misc_feature (662)..(662): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaagcgtgggggtccctgagactctcctgcgcagcctctggtattcaaccttcagtagttanagcatgaacgtcgggtaccgccgaggccgtccggaaggggaaggggcgtaggggaggttggggtcctcgtactaccaagtttaagttaaggtaaattacggtaccgtacccttaacgaacggtaaacttaacgtaccgacacggtaacttaccgacgtagggaaccgggacccgacctaccgaaccctattacccacgaacggacgaaaccaaccggaacccaaacgtaaaccnccgtacctaagtatacctaagaaccctaaatacgaaaccgtacgacggtagagaacgtccggaacgtaccgacggccgttagtacggtttanaacgtgtacggcgaaggacgtagtaacttactacgttacgacccgtaaaccgtntttacggtttacg

SEQ ID NO: 344863 - DNA, 720 bp, Homo sapiens
  misc_feature: GZ8MTXP02HZTQP.11.27.C05.1.454.CMB.2.raw
  modified_base (287)..(287): a, c, t, g, unknown or other
  misc_feature (287)..(287): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgtcgcttattttagaaggtgtccagtgtgaggtgcagctggtggagtcgtgggggaggcctggtcaagccgtgggggtccctgagactctcctgcgcagcctctggtacttccaccttcagtagttanagcatgaacgtcgggtccgccgaggccgtaccggaggggaacggggccgtagggacggttcgggttctcgtacttaccgtaagtttaaggttaagtaaagttacgtacccgtacccgtaaacaggtaacttaaccgtaacccgactaccggtacctaaccgtaacgtaacgggaaccggggaccccgaaccttacccaaccctagtacccctaccgaaggaaccaaacccgaaacccgaccgaaaagaccctacacgttacgtaactcgtagaaactaaagtacgaaacgacgtaccgtagaacggacggaccggaaagggttacccgaacggtctttacggtacgttttaacgttaaccgtggtacggaggtaggaacggtactaacgtttaattacgttcgaacccggtaaacccgtatttccgtttacgg

SEQ ID NO: 344864 - DNA, 654 bp, Homo sapiens
  misc_feature: GZ8MTXP02HVFTR.11.27.C05.1.454.CMB.2.raw
  modified_base (282)..(282): a, c, t, g, unknown or other
  misc_feature (282)..(282): n is a, c, g, or t
  modified_base (521)..(521): a, c, t, g, unknown or other
  misc_feature (521)..(521): n is a, c, g, or t
  modified_base (580)..(580): a, c, t, g, unknown or other
  misc_feature (580)..(580): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggagctggtcaagccgtggggggtcctgagactctcctgcgcagcctctggattcaccttcagtagttanagcatgaacgtcgggtccacgaggctaccgagggggaggggcgtgggaggtcgggtctcacttccagttagtagtaatacgtcgacctacagtactactaccgacacgtactacacgtaggaaccggggccgactacccaaccgtactacccgtaaccgaaggtacgaaaacccaacggaaaccctaaaggtaaacccttcaacgttataaacgtcctaagaaccttaaaagcgaaacncgtaccgagaggaacgcccggaaggtaaccgacgggtctagggtacttacgtttaacgnggtacggacgtaaggtaagtactaacgttaacgttaacgtaccggaaccggttaacccgttggtttacgtttcg

SEQ ID NO: 344865 - DNA, 589 bp, Homo sapiens
  misc_feature: GZ8MTXP02JS03H.11.27.C05.1.454.CMB.2.raw
  modified_base (369)..(369): a, c, t, g, unknown or other
  misc_feature (369)..(369): n is a, c, g, or t
  modified_base (409)..(409): a, c, t, g, unknown or other
  misc_feature (409)..(409): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggcctccggaggggaacggggctggaggtgggtctcatccattaagtagtaaatagtcgacctanagatactacgcagactcacgtagacggggccactcaaccntctaccagacgaacaacgaccaaagaacctcaactgtaaactctagaacctaaatacgaaaccgagacccgtaggaacggacggaccggaaggaccgaacggcttacggtagttaattacgtggtcgacggtaagaggggatcgttagttactcgtaccggaaaccctagtacgtttacg

SEQ ID NO: 344866 - DNA, 624 bp, Homo sapiens
  misc_feature: GZ8MTXP02IGO12.11.27.C05.1.454.CMB.2.raw
  modified_base (303)..(303): a, c, t, g, unknown or other
  misc_feature (303)..(303): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcagccgtggggggtccctgagactctcctgcgcagcctctggtattctaccttcagtagttatagcatgaactcgggtccnccgaggctccggaggggaggggctggagtgggtctcatcattagtagtaatgtcgacctacagatacgtacgacagaccttacacgttacgggaacgggcccgaactccaaccctactcctaccagaacgaacccgaaacgacccaaagaacctaccactacgtactctacgaactaaatacgtaaacacgtacccgtaggacgacggaccggaacggacgtaccgggacgttacgtagttataccgttaggtacggacgacggaggtaggtaacgttaacgttactaccggtaaccggtaacccccggtattacgtttcg

SEQ ID NO: 344867 - DNA, 803 bp, Homo sapiens
  misc_feature: GZ8MTXP02F5Z2M.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtggtggagtcggtgggggaggccgtggtcaaggccggtcggggggtccctgacgactctcctgcgcacgcctcgtgtacttcctaccttcgagttagttatagacagtagtaccgtcgggtcccgccgacggtcctaccgggaaggggaacggggtcgtaggggtaggttcggggtcctacgtacgttaccgtaaagtttaaaggtaagttaaagttcggtaccccgtaccgtaacgtaaggtaacttaaccgtaccggacacggtacctaccgtaaacggtaacggggaacccgggggtaccctaaccgttacccaaaccctacgttacccgaaccgaaacgaaaccggaaacccgaaaacccgaacccgtaaaacggtaacccccttactaacccgttaggtttaacctaccccgttaagaaaaccgttaaaacgaccgtaaaaccggaccgtacccgtaggaaacgggtacccggaaccgggaacggtaccggacgttcgttaacggttagtttaaacttcggtaggacggtacggaaaggtaggtacgtaacgtttagtaaccgtaccggaaccggtacccgtagtttcgtttttaacgg

SEQ ID NO: 344868 - DNA, 670 bp, Homo sapiens
  misc_feature: GZ8MTXP02JK0MS.11.27.C05.1.454.CMB.2.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (458)..(458): a, c, t, g, unknown or other
  misc_feature (458)..(458): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtgggggtccctgacgtactctcctgcgcgagtccgtcgtggacttccgaccttcgagtagttaanagtcaagttcgaactcgggtccncccgtaggcctccgaggggaaggggtctgggaggtcggggtactcgtaatccaagtttagtaagtaaatggtacgccctaagagtaactactacggacagaccttacacgtaggaaacggggtcccaactccaaaccctntacctaccgaaggacgaaccaaaccgccaaagtaaccctcctaacgttctaactcgtaagaactaacgtacgaacgtacgaccgacggacggacggaccggaacggacgaccgtacgtacgttacgttacgttacgtacggtacggacggaacggtaaggtacggtaacgttacgttaacgtacggtaccggtaccgtacgttacgtttacg

SEQ ID NO: 344869 - DNA, 536 bp, Homo sapiens
  misc_feature: GZ8MTXP02FIAVP.11.27.C05.1.454.CMB.2.raw
  modified_base (299)..(299): a, c, t, g, unknown or other
  misc_feature (299)..(299): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccnccaggctccgaggggaaggggctggagtgggtctcatccattagtagtaatgtcgcctacagatactacgcagactcactgaacgggccgactcaccatctccagagacaacgccaagaactcaactgtatctagacaaaatgaaacagcctagacgagaccgaggaccacggctgtgtattactgtgacgtaggaggagcttaattactacgtacggaaaccccgtatcgtttacg

SEQ ID NO: 344870 - DNA, 613 bp, Homo sapiens
  misc_feature: GZ8MTXP02FHSFL.11.27.C05.1.454.CMB.2.raw
  modified_base (334)..(334): a, c, t, g, unknown or other
  misc_feature (334)..(334): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctatttttagaaggtgtccagtgtgaggtgcagctggtggagtctgggggaggcctgggtcaaggcctgggggtccctgagactctcctgcgcagccgtctggattcaccttcagtagttatagcatgaactgggtccgcaggctccgagggaaggggctggagtgggtcncatctattagtagtaagtagtcgacctanagtactacacgcanactcacgtagaacggccgactcaccactccacaacgacgaaccaaaccgaaccaaacgaaacctacactacgtactctacgactaaagtacgaaaccgacgtaccgtacggacggaacggaccggaaacggaccgaccggtcgtacggtagttacgttacgtggtacggacggaacggaacggtaacgtaacgttaacgtttaacgtaccgtaccggaaccccgtagttcgtttcg

SEQ ID NO: 344871 - DNA, 580 bp, Homo sapiens
  misc_feature: GZ8MTXP02IZR85.11.27.C05.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggattcaccttcagtagttatagcatgaacgtgggtcccnccgaggctccgagggaggggctggagtgggctcactcctattagtagtaatagtcgcctanagtatactacgcagactcaacgtggaacgggcccgactccaccatcctaccagacgaaccaacgaccaaacgaactcgactgtaatcgtagactaaatcgaacagtcccgagacggacgaccggaggaccgacggcgttgtagtattacgtggtacgacggaggacggagtaactaattacgtacggtaaccggtaacccccgtgtacgttttccgg

SEQ ID NO: 344872 - DNA, 549 bp, Homo sapiens
  misc_feature: GZ8MTXP02F2JQD.11.27.C05.1.454.CMB.2.raw
  modified_base (301)..(301): a, c, t, g, unknown or other
  misc_feature (301)..(301): n is a, c, g, or t
  modified_base (361)..(361): a, c, t, g, unknown or other
  misc_feature (361)..(361): n is a, c, g, or t
  modified_base (499)..(499): a, c, t, g, unknown or other
  misc_feature (499)..(499): n is a, c, g, or t
  modified_base (541)..(541): a, c, t, g, unknown or other
  misc_feature (541)..(541): n is a, c, g, or t
tcagcgagagataccacgaccggtgctcgatttagacgcgatcgaagggtttgggggagagaggagccttagccctggattccaaggccctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagtatagcatgaactgggtccnccgagctccgagggaaggggctggagtggtctcatccattagtagtaatagtcgccctanagatactacgcagactcactgaacgggccgactcacccatcctccaagacaacaacgccaaacgactcactgtatctgaaccaaatagaaacacgcctaggaagacggaccgaggaccaacggctgtagttattacgnggttgacgtaaggagagaatattactcgaccggaccccgtancgtttacg

SEQ ID NO: 344873 - DNA, 683 bp, Homo sapiens
  misc_feature: GZ8MTXP02GB0K0.11.27.C05.1.454.CMB.2.raw
  modified_base (629)..(629): a, c, t, g, unknown or other
  misc_feature (629)..(629): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggacgcctggtcaagccgtcgggggtcctgacgactctcctgcgcagcctcgtggtacttccaccttcagttagttaatagacatagaacgtcgggtacccgccgacggcctaccggaaggggaacggggcggtaggggtacgggttggggttcctacgacgttacccgtaaatttaaggtaagtaaagttagtacccgtaccctaacgagtaaacttacaacgtacagacctacaacgtacggaaccgggaccgactacaaccctatcctaccgaagacaaaccgaaaccgacccaaaagtaacctcctaaactcgttaacttctaacggtaacaaacgtagaaacctagacccgaggacgaacggaccggacgaacggcggacgttcggtagttattacgtggacggacggaacgnggtacgtaacttacttacggttacgtacccggaaacccgtagtacttttaacgg

SEQ ID NO: 344874 - DNA, 630 bp, Homo sapiens
  misc_feature: GZ8MTXP02ICKUD.11.27.C05.1.454.CMB.2.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (592)..(592): a, c, t, g, unknown or other
  misc_feature (592)..(592): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggaggtcgtgggggagcctggtcaagccgtgggggtccctgacgactctcctgcgcacgcctctggtattcctaccttcagtagttaatagcatagacgtcgggtcccgccaggcctaccggaggggaacggggctaggggaggtggggttctcagtcctattaagtataatagtcgaccctanagatactacgnacgacctcacgtacggaacggcccgactcccaccctatccctaccgaagaacgaaccctaaaccgaccaaaagaacctacgtacttactaaacttccgtacgaaccttaaaagacgaacacgggtcctaggacggacgtaccgggaaggaccgtacggtctacggtagtttacttacgtggtacgacgaggaggtanaactttagtacgtcgaaccggaccctagttcgtttacg

SEQ ID NO: 344875 - DNA, 610 bp, Homo sapiens
  misc_feature: GZ8MTXP02IDXEO.11.27.C05.1.454.CMB.2.raw
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (483)..(483): a, c, t, g, unknown or other
  misc_feature (483)..(483): n is a, c, g, or t
  modified_base (555)..(555): a, c, t, g, unknown or other
  misc_feature (555)..(555): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagcgtggtggagtcgtggggaggccgtggtcaaggccgtgggggtccctgagactctcctgcgcacgcctctggattccaccttcagttagttatacggctaatggaaaccgttcggggtccccgaccgacgggtcctaccgggaaggggtaacgggggcctggggaggttcggggtctcgatacccgtagttagtaagtaatgcgtcccaanagatacacgcagactcagtaggaacgccactcacnctcacanacgacaacgccaaagactcgattgtaatcgtaancaaaatcaactagcctaggacgacgcgaggaccgacggtctagttagactttcgaggtcggaacggaacggngggactaattaacgtttactccggaacccgtaaacccggttgtaacgtttttccg

SEQ ID NO: 344876 - DNA, 573 bp, Homo sapiens
  misc_feature: GZ8MTXP02GIN0Q.11.27.C05.1.454.CMB.2.raw
  modified_base (301)..(301): a, c, t, g, unknown or other
  misc_feature (301)..(301): n is a, c, g, or t
  modified_base (407)..(407): a, c, t, g, unknown or other
  misc_feature (407)..(407): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggagggctggagtgggtctcatccattagtagtaaatagtcgacctacagatactacgcagactcactaggaacgggccgactcaccattccnccagacgaacaacgccaaagaacctcgactgttactctacgactaaaatacgaacaacgtccgagacggacggaccggagggaaccgacgggcttggttacgttattacgtggtacggacgaaggaggagcttattaacgtctaccggaccccgtagtcgtttacg

SEQ ID NO: 344877 - DNA, 606 bp, Homo sapiens
  misc_feature: GZ8MTXP02IVSWS.11.27.C05.1.454.CMB.2.raw
  modified_base (299)..(299): a, c, t, g, unknown or other
  misc_feature (299)..(299): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctgggtttcctgttgctattttagaaggtgtccagtgtgaggtgcagctggtggagtcgtgggggagcctggtcaagccgtggggggtccctgagactctcctgcgcagcctctggattcaccttcagtagttatagcatgaactgggtccncaggctcgagggagggctggagtgggtctcatccattagtagtaatagtcgacctacagatacctacgcaggctacacgtagaacggggccaactcaacctatcctaccaagagaaacccaacgccctaaagaactcacttgtactactgaactaaatcgaactgaccctaggacgacggacccgtaagggaaccgtacgggcgtttaggtcggttaaactttccgtagggtcggaacggagggaacgggtataacgtttaaattacgtacccggtaacggaaaacccccgttgttacggttttccg

SEQ ID NO: 344878 - DNA, 687 bp, Homo sapiens
  misc_feature: GZ8MTXP02FXBA3.11.27.C05.1.454.CMB.2.raw
  modified_base (305)..(305): a, c, t, g, unknown or other
  misc_feature (305)..(305): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagttagtatgacatagaacgtgggtcccncgaggcctaccggaggggaggggcgtggaggtgggtctcgactcctagttagtagtaatagtcgtacctacagtatactacgacagacctacacgtaggacgggacccgacctaccgaccctaacttcccacccgaagaacgaaaccgaaacccgaccaaaacgaacctaccaacctagttaacttacccgttagaaacctaaagtaacgaaaccacggacccctaagggacgacgggacccggaaggaacccgtacggtccttaaggttacgtttaatttaccggtaggttacggcggtaaaagggtcggtaaacgtaacccgtttaagttaaaacgtccggttaacccgggaaaccccgttggtttacgtttttaaccgg

SEQ ID NO: 344879 - DNA, 604 bp, Homo sapiens
  misc_feature: GZ8MTXP02FZ4WU.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggattcaccttcagtagttatagcatgaactcgggtccgccgaggctaccggaggggaaggggctggagttgggtctcgatcctaattaagtagtaatgtcgacctacagactactacgcagactcaacgtacggaacgggcccgaacctaccaacccaattccctaccaagaacgaaccaaaccgaccaaagaacctacacttgtatctagaaccaaatacgaaacacgcctaggaagacggaccgaggaccgacggtctagttagtatttacgtggacgcggaacggacggaatcgttaattacgtaccgtaaccggtaaccccgtagttcgtttacg

SEQ ID NO: 344880 - DNA, 599 bp, Homo sapiens
  misc_feature: GZ8MTXP02GIC24.11.27.C05.1.454.CMB.2.raw
  modified_base (301)..(301): a, c, t, g, unknown or other
  misc_feature (301)..(301): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccnccaggctccgaggggaaggggctggagtgggtctcgatccatttagtagtaaatagtcgcctacagtatactacgcagactacacgtagaacgggcccaacgtccaaccacttaccaccaagaacgaaccaaacgacctaaacgaacctcactagtactctagactaaatcgaaacagaccctaggaacgacgaccggaaggaccaacggtctagtagttaattaccgtgtacggacggaaggacggtagtaaccttaagtttaactccgtaccggtaaccccgtagttcggtttacg

SEQ ID NO: 344881 - DNA, 610 bp, Homo sapiens
  misc_feature: GZ8MTXP02HTE9M.11.27.C05.1.454.CMB.2.raw
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (562)..(562): a, c, t, g, unknown or other
  misc_feature (562)..(562): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcagccgtgggggtccctgacgactctcctgcgcacgcctctgacttcaccttcagtagttatagcatgactcggtcccgcaggctcgagggaaggggcgtaggaggtggtctctactcctattagttagtaagtagtcgacctacgagtactacgtacgcacgactcacgtacggaacgggcccgactcccaacactacctacagaacgaccgaaaaccaccgaaaacgtaacctctaaccttgtacttcgtanaacgtaaatacgaaaacncgaccgtgaacggacgaccggagaccgacgtctaggttacgttatacgtagtcgacggaagacggtanaaccgttagttacgtaccgtaaccgggtaaccctagtttacgtttacg

SEQ ID NO: 344882 - DNA, 711 bp, Homo sapiens
  misc_feature: GZ8MTXP02F2NHW.11.27.C05.1.454.CMB.2.raw
  modified_base (609)..(609): a, c, t, g, unknown or other
  misc_feature (609)..(609): n is a, c, g, or t
  modified_base (634)..(634): a, c, t, g, unknown or other
  misc_feature (634)..(634): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatgaactgggctccgctggttttccttgttgctattttagaaggtgtccagtgtgaggtgcagctggtggagtcgtgggggaggcctggtcaagccgtgggggtccctgacgactctcctgcgcagcctcgtgacttcaccttcgagttagttatgcagtgaacgtgggtccgaccaggcctccggaggggaaggggctgggaggtcgggtctcgatccgtaagtttagtaagtaaagtacgtacgtaccctagaagacttaacgtaaccggactacggtaccttacaaaccgttaggaaaccggggacccgtaaccttacccaaaccctattccccgtacccgaaaaggaacaacccgaaaaccgccccgtaaaaagtaaacctccctaaacgtgttaaacctaccgtaggaaacctaaaagtacgaaaaccgtagacccgttagaacgggacgaaccggtacggaaccgttaccgggngtttacggttacgttaagttacggngtacggaacggaggtacggtaacttaaccgtttaagttaaccgtcccggtaaccgtaacccgttgtttacgtttacg

SEQ ID NO: 344883 - DNA, 762 bp, Homo sapiens
  misc_feature: GZ8MTXP02HLBUI.11.27.C05.1.454.CMB.2.raw
  modified_base (288)..(288): a, c, t, g, unknown or other
  misc_feature (288)..(288): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtcggggggtccctgagactctcctgcgcagcctctggtattccaccttcagtagttanagctatagaacgtcgggtccccgccgaggcctaccggaggggaacggggtcgtaggggaggtggggtcctcgattcctaagttaggttaagtaaagttagtccgtaccctaacagtaactaccgtaaccgacgacgtacctaccgaacgttacggggaaaccgggcccgtaaccttacccaacccgtattccctacccgaaggaaacgaaacccgaaaaccgacccaaaagtaaaccctacacttagttaaacctcgtaacggtaacctaaaagtacgaaaaccgacggtaacccgttaggaaacgggacggaacccgggaacggtaacccggacgggtacgtttacgggttagtttaaacgtttacggtacgggttacgggacggggaaacggtaaggggtacgtaacctttaaagttttaaccgtacccggtaacccggggtaaaccccttacggtttcggtttttaaccgg

SEQ ID NO: 344884 - DNA, 559 bp, Homo sapiens
  misc_feature: GZ8MTXP02HAJL7.11.27.C05.1.454.CMB.2.raw
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (440)..(440): a, c, t, g, unknown or other
  misc_feature (440)..(440): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgcttattttagaaggtgtccagtgtgaggtgcagctggtggagtcgtgggggaggcctggtcaaggccgtgggggtccctgagactctcctgcgcagcctntggattcaccttcagtattatagctatgaacgtcgggtccgccgaggctccgaaggggaaggggctggaggtgggtctcgatccatttagtaagtaatagtcgacctanagatactacgnagactnactggaacgggccactcaccanctcanagacacgacaagaactcactgactntagacaaatacgaacacgccagagacggcgagacgacgactcgtagtattacgtgtgacgtacggaggtacgaacgttacgttacgtaccgtaccggaacccctagttacgttttccgg

SEQ ID NO: 344885 - DNA, 600 bp, Homo sapiens
  misc_feature: GZ8MTXP02I76R4.11.27.C05.1.454.CMB.2.raw
  modified_base (303)..(303): a, c, t, g, unknown or other
  misc_feature (303)..(303): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgcgcagcctctggacttcaccttcagttagttatagcatgaacgtgggtccnccaggctccgaggggagggctggagtgggtctcgatccattaagtagtaagtagtcgacctacagacttactaccgcacgactcacgtagaaacgggcccgtactcccaaccactccctacaaggaacaccgaaacgacccaaagaactcactgtactcgtagacctaaagtacgaaactacgaccgtagaaggacgacggaacggaccgacggtcgtacgtgtttaaacttcgtgtacggacgtacgaggagtaacttaattaacgtcgtaaccggtaccctagtttcgttttacg

SEQ ID NO: 344886 - DNA, 596 bp, Homo sapiens
  misc_feature: GZ8MTXP02FNWSM.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagttagttatagcatgaacgtgggtcccgccgaggctccgaggggaacggggctggaggtgggtctcgatcctattagtagtaaatgtcgcctacagtatactacgcagactcacgtgaacgggccgactccaccatcctaccagacgaaccaacgacccaaagaacctcgactgtactctagactaaaagtcgaaacacgaccctaggaacggcggaaccggaggtaaccgacgggcgttagttacgttaattaccggtggtaggacggaggagggataacgttaagtctacggaccggtaaacccctgtacgttttcg

SEQ ID NO: 344887 - DNA, 525 bp, Homo sapiens
  misc_feature: GZ8MTXP02I56SP.11.27.C05.1.454.CMB.2.raw
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (468)..(468): a, c, t, g, unknown or other
  misc_feature (468)..(468): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagttatagcatgaactgggtccgccaggctccgagggaaggggctggagtgggtctcatccattagtagtaatagtcgacctacagatactacgcagactcactgaagggccgactcacntctcaganacacgcaagaacncactgtaatctagacaaagtagaacagccgagagacgacgaggacacggntgtagtatacgtgtcgacgagagagtaagtattacgacgtacgaccgtagtcgttcg

SEQ ID NO: 344888 - DNA, 594 bp, Homo sapiens
  misc_feature: GZ8MTXP02IGUQ6.11.27.C05.1.454.CMB.2.raw
  modified_base (373)..(373): a, c, t, g, unknown or other
  misc_feature (373)..(373): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgcgcagcctctggtacttcaccttcagtagttatagcatgacgtcgggtccgccgaggcctccggaggggaggggcgtgggagtgggtctcactcctattagtagtaatagtcgacctanagactactacgcacgactacacgtaggaaccggccgactccacctatccaccagacgaaccaaacgaccaaagaactcactagtactctagactaaaatacgaacacgccgtagaacggacggaccggaggaccgtacggactttggtacttaacttacgtggtacgacgaggtagacgtaacttagttaactacgaaccggtacccgtagttcgtttacg

SEQ ID NO: 344889 - DNA, 637 bp, Homo sapiens
  misc_feature: GZ8MTXP02G2MJT.11.27.C05.1.454.CMB.2.raw
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctccgtgcgcagcctctggtattccaccttcagttagttatagcatcgaacgtcgggtccgccgaggcctaccggaaggggaacggggcgtagggacggttggggtcctctacgtacctagttaagtaacgtaaataggtccgtacctaacagaactactacgacacgacctacgacgtagggaacgggccactcaaacctntacccncgaagacgaacctaaacgcccaaagacctacactgtaactctacgaaactaagacaaacgcgtaccgaggaacgacggaccggaacgacgacggtacttggttacgttattacggtggtaccgacgaagggtaacgagtaacttagttaccgtacgaccggtaaacccgtgtttcgtttacgg

SEQ ID NO: 344890 - DNA, 535 bp, Homo sapiens
  misc_feature: GZ8MTXP02HU41Z.11.27.C05.1.454.CMB.2.raw
  modified_base (373)..(373): a, c, t, g, unknown or other
  misc_feature (373)..(373): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggggtccctgagactctcctgcgcagcctctggattcaccttcagtagttatagcatgaactgggtccgccaggctccgagggaaggggctggagtgggtctcatccattagtagtaatagtgcctacagatactacgcngactcactgaagggccatcaccatctccagagacaacgaccaagaactcactgtatctgacaaatagaaacagcctaggagacgcgacggacacggctgtagttattaactgtggacgaggaggaggtcgtattatcgttacggaaccccgtatcgtttacg

SEQ ID NO: 344891 - DNA, 713 bp, Homo sapiens
  misc_feature: GZ8MTXP02HIV7O.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcagccgtgggggtccctgagactctcctgcgcagcctcgtgtacttccaccttcagttagttatagctatcgaacgtcgggtcccgccgacggcctccgggaaggggaacggggcgtaggggtaggtcgggtcctcgacttcctaagtttaagtaagtaaatacggtaccgtaccctaagaacgtaaattacctaaccggcacgacctacgaacgttacgggaaacggggtccccgaactacccgaaccctactacccgtaccgaaaggaaccaaaccgtaaaccgacccaaaagtaacctactacttacgtatacgtaagaaccgtaaaatacgaaaccgtaacgccgtaaggaaccggtaaccggaccgggaaccggtaccggaccgggtcgtttaacggttacgttacttaccggtaggtacggacggaacgggaggttactaagtttaataccgttccgtaaaccggtaccccgtatttcggtttaccg

SEQ ID NO: 344892 - DNA, 708 bp, Homo sapiens
  misc_feature: GZ8MTXP02JV27J.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtggggaggcctggtcaaggccgtggggggtccctgagacctctcctgcgcagcctctggattcaccttcagtagttatagcagtagaacgtcgggtcccgccgacggccgtaccggaaggggaacgggggtcgtaggggacggtggggtctactacgtacctaagtttaaggtaagttaaagtaggtaccgaccctaacacggtaactaacgccccgtacgaccgtacgtacccttacgtacgggtaccggaccggtaccctaccctaacccaccgtaccctacccgtaacgaccgaaacgaacccgaaaccgaaacgtaaccactacgtacgtatacgtacaacgaaagtaacgaacgaaacgcgacgaacggaccggaacgggaccgaacggtaccgtacggtcgttacgttacgaccgtacggtgggacgaacggaacgggtaacgtaacgttaacgttcgtacggttaacccgacccggttaacgtttcgaaaacg

SEQ ID NO: 344893 - DNA, 629 bp, Homo sapiens
  misc_feature: GZ8MTXP02F5XNQ.11.27.C05.1.454.CMB.2.raw
  modified_base (257)..(257): a, c, t, g, unknown or other
  misc_feature (257)..(257): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggagggtccctgagacctcctcgcgacncgcgtcctcgagttacttaccctaccgttagtagttaattaagacgtactaagtacgtaacggtccggtacccaccggtacgccggtacgggaagggggtaccggtggtaggggtgggttcgtacccagtacctattaaagttaagtaaattaacgtccgttacgaccaagagtactacgacnganctcgagtaggacgacctacaccacacgtcccaagagaacaaaccgacctaaaccgaaatcccaancgtatacttgaacaaatanagaacgacncgagacgacgacggaacgacgaccgtacgtagtagtacgtagttgacgacggaggagaagtacttattactacgtaccgtaccgtacgtttcg

SEQ ID NO: 344894 - DNA, 622 bp, Homo sapiens
  misc_feature: GZ8MTXP02I6KW5.11.27.C05.1.454.CMB.2.raw
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcagccgtgggggtccctgagactctcctgcgcagcctctggacttcaccttcagtagttatagcatagaacgtcgggtcccgccgaggcctccgaggggaaggggctgggagtgggtctcatccattagtataatagtcncctanagtaactactacgcagactcacgtagaacgggccgacacaccattcccacaacgacgaaccaaacgaccaaagaacctctaactgtaacttctacgaactaaaagtcgaaaccgtacgacccgtaggaacgaacggtacccggaaagggaccgaccggtgtgtacgttattaacgttggacggtacggacggtaggggaatccgttaagtttacgttaccggtaaccgggtaacccccgtagtttcgttttacgg

SEQ ID NO: 344895 - DNA, 611 bp, Homo sapiens
  misc_feature: GZ8MTXP02GMI38.11.27.C05.1.454.CMB.2.raw
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccaggcctccgaggggaaggggctggaggtgggtctcactcctattagtagtaatagtcgcctacagatactacgcagactcacgtaggaacgggccgactccaaccctattcccaccgaagacgaaaccaacgacccgaaaagaccctacacgtnttatccgtaanaactaaagacgaacacgaccgaggaacgcggtacggaacggaccgcgggtcttacggttatacgttacgtgggtacggacggaacggagtacgtaacttaacgttacgtaccggacccggtaaacccttggtttacgtttcg

SEQ ID NO: 344896 - DNA, 591 bp, Homo sapiens
  misc_feature: GZ8MTXP02JVL67.11.27.C05.1.454.CMB.2.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaagtgtccagtgtgaggtgcagctggtggagtcgtgggggaggccgtggtcaagccgtggggggtccctgagactctcctgcgcagcctctggacttcaccttcagtattatagcatgaactgggtccncgaggctccgagggaaggggctaggagtgggtctcatccatagtagtaatagcgcctanagatactacgcagactcacgtgaacggccgactccgaaccatcctccagacgaacaacgccaaagaactcactgtatcgtagacaaatacgaacacggcctagacggacgaccggaggtaaccacgggtcttaggtagttaattaccgtggtaccggacgaacggtagggagtaaccttaaagtttaacgacccgttaacggggaaaacccccttagtcggtttttaaccg

SEQ ID NO: 344897 - DNA, 782 bp, Homo sapiens
  misc_feature: GZ8MTXP02JSUX7.11.27.C05.1.454.CMB.2.raw
  modified_base (336)..(336): a, c, t, g, unknown or other
  misc_feature (336)..(336): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcggtgggggagccgtggtcaagccggtgggggtccctgagactctcctgcgcacgcctcgtggtacttcctaccttcagtagttatagcatagacgtcggtccgccgaggcctacggaggggaacgggngtacggaggtcgggtctactactcgtaattaagtagtaagtagtaccgacctaagataacttacgtacgacgtaccgtactccgtaacggtacgggaaccgggtaccgtacctaccctaccctaactacccctaaccgaacggaaacccgaaacccaaacccggaaaccccaaaacggtaaaaccccttcccgtaaaacgttccggtttaaacttaccggttaaaccggtaaaacctaaaaaggttaacccgaacccgtaacggttaaccccggtaagggaaccgggaacccgggaaacccggacggggtaaaacccgtccggggtacgtttaacggttacggtttaaacgtttaccgggtggttaacggacgggtaaaggaccgggttataaaccgttattaccggtacccggtaacccggacccctttaaggttccttttacgg

SEQ ID NO: 344898 - DNA, 598 bp, Homo sapiens
  misc_feature: GZ8MTXP02I6I16.11.27.C05.1.454.CMB.2.raw
  modified_base (368)..(368): a, c, t, g, unknown or other
  misc_feature (368)..(368): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcaccttcagtagttatagcatgaacgtgggtcccgccaggcctccggaggggaggggcgtggagtggtctcatcctattagtagtaatagtcgacctanagtatactacgcagtactacacgtgaacggggccgactccaacctatccctccgaagacgaaccaacgaccaaagaacctcacttagtactcgtagacctaaatcgaaactcgacctaggaacgacgtcccggaaggaccacgggtcttaggttcgttaagttaccgtggtcgacggtagaggacgtaacttacttacgtaccgtacggtaaaccccgtgttacgtttcg

SEQ ID NO: 344899 - DNA, 600 bp, Homo sapiens
  misc_feature: GZ8MTXP02HXBYH.11.27.C05.1.454.CMB.2.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtcctgagactctcctgcgcagcctctggattccaccttcagtattatagcangaactgggtccnccaggctccgagggaggggctggagtgggtcacatccattagtaagtaatagtcgcctaacgagtactactacgcacgtactcacgtgaaacgggggtcccaactcccacctaatcctaccaagaacgaaccaaaccggaaccaaagtaaccctcgacgttgtactacgagaaccgtaaatacgaacacgacgtacgagacgacccggaaaggccaacggtctaggtcgttagttaccgtggttacgacggaagtacggataaccgttatacgtcgtacggaaccccgtagttacgtttcg

SEQ ID NO: 344900 - DNA, 665 bp, Homo sapiens
  misc_feature: GZ8MTXP02GCI5V.11.27.C05.1.454.CMB.2.raw
  modified_base (309)..(309): a, c, t, g, unknown or other
  misc_feature (309)..(309): n is a, c, g, or t
  modified_base (589)..(589): a, c, t, g, unknown or other
  misc_feature (589)..(589): n is a, c, g, or t
  modified_base (608)..(608): a, c, t, g, unknown or other
  misc_feature (608)..(608): n is a, c, g, or t
  modified_base (629)..(629): a, c, t, g, unknown or other
  misc_feature (629)..(629): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctcgtggacttccaccttcagttagttatacgcatgtaacgtgggtcccncgaggcctccgaagggggagggtctggggagtgggtcctacgacttccaatttaagtaagttaactagtccgaccctacgaagtacttaactaccgacacgtaccttacgaacgtacggaaacggggtcccgaacttcccgaaaccattcccacccgaaaaggagaaacccgtaaaccgacctaaaacgaaaccctcaaactggttaaacttccaagaacccgaaaattcggaaaaccacgtcccgaaggagaccggacgggtaacggaccgtaacggtnttaggtacgttaattacgnggtacgacggaaggagtacgnttaacttacgtacgacggtaaaccctgtctttacgg

SEQ ID NO: 344901 - DNA, 658 bp, Homo sapiens
  misc_feature: GZ8MTXP02GJQHD.11.27.C05.1.454.CMB.2.raw
  modified_base (533)..(533): a, c, t, g, unknown or other
  misc_feature (533)..(533): n is a, c, g, or t
  modified_base (645)..(645): a, c, t, g, unknown or other
  misc_feature (645)..(645): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagcgtgggtggagtcggtgggggaggccgtggtcaaggccggtggggggtccctggacgactctcctgcgcacgcctcgtggattccaccttcagttattatagcatgaacgtcgggtcccgccgaggcctccgggaaggggaaggggcgtgggaggtgggtctcactacctagtttaacgtagtaaagttgtccgaccttaacgaagtaacttaacctacgacagtacctacgtaacgtagggaacggggaccctaactaccaacccattcccaccgaagacgaaccaacgaccaaaagaacctcaactgtaactcgtagaacctaaagtacgaaacncgtaccgaggaacggacggtaccggacggaaccgacggtcttaggtagttaacttacgtggacgacggaaggaggtacaacgttaattacgtaccgtaccggtaaacccgtntttacggtttacg

SEQ ID NO: 344902 - DNA, 525 bp, Homo sapiens
  misc_feature: GZ8MTXP02JURM0.11.27.C05.1.454.CMB.2.raw
  modified_base (299)..(299): a, c, t, g, unknown or other
  misc_feature (299)..(299): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgcgcagcctctggattcaccttcagtagtatagcatgaactgggtccnccaggctccgaggggaaggggctggagtgggtctcatccattagtagtaatagtcgctacagatactacgcagactcactgaagggccactcaccatctccaagagacaacgccaaagaactcacgtnatctagcaaaananacancagagacgacgagacgacgctgtagtatacgtgtgacgagaggagtaacgtattactacgtacggacccgtacgtcgtcg

SEQ ID NO: 344903 - DNA, 588 bp, Homo sapiens
  misc_feature: GZ8MTXP02F29RJ.11.27.C05.1.454.CMB.2.raw
  modified_base (374)..(374): a, c, t, g, unknown or other
  misc_feature (374)..(374): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggttcgccaggctccgaggggagggctggagtgggtctcatccattagtagtaaatagtcgcctacagatactacgacngactcacgtagaacggggaccgacctccgaaccatccctaccgaagaacgaaccaaaccgcccaaaaggaacccttacaactgtaactcctgacctaaaagtcgaaacacgcctaggacgaacggacccgaggacacgggcttggtacgttattcgtggcggtcggaaggaggagtaactttattacgtaccgtacggaacccgtatgtttacg

SEQ ID NO: 344904 - DNA, 859 bp, Homo sapiens
  misc_feature: GZ8MTXP02FREC3.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctggtttcctgttgctatttagaggtgtccagtgtgaggtgcagctggtggagtcgtgggggagcctggtcaagccgtggggggtccctggagactctcctgccgcagcctcgtggacttcaccttcagttagttatagacatacggaacgttcgggtcccgaccgagggcctccggaaggggaacggggcgttgggaggttcggggtactacgtagtacccgtaagtttaacgtaggttaaaacgttaggtaccggtaccccttaacgaacgtaacgttaacccgttaaaccggaccgtacgggtaaacccttaccgaaaccggtttaacgggggaaaaccgggggtacccccggtaaacccttacccggaaaacccccgttaacgtttaccccctaaacccgaaacggggaaaaccctaaacccgaaaaacccgggaaccccctaaaaaggtaaacccccttaccaacccgttagttaacctaccgttaacgaaaccgtaaaacgtcggaaaaactaccggtacccgtaaggaacggaccggtaccccggaaagggacccgtacccgggacttaacgggttagttaaaacccttttcgggaagggttaccggaacggggtaacgggaacgggtaaggtaaccgttttaagtttaccgttaacccgggttacccggggtaaaaccccccttgtttaccccgggtttttaacgg

SEQ ID NO: 344905 - DNA, 675 bp, Homo sapiens
  misc_feature: GZ8MTXP02GFMGV.11.27.C05.1.454.CMB.2.raw
  modified_base (512)..(512): a, c, t, g, unknown or other
  misc_feature (512)..(512): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtgggtccgccgaggctccgaggggaaggggcgtgggaggtgggtctcgatacctagtttaagtaaggtaaattaggtcgtacctacaaggtaacttactacgactaggactacacgtaggaacggggaccctactaccacccattccctaccaaggaacgtaaacccaaaccggacccaaaacggtaaaccctacgacctagttaaactcccgtaaanaaacaaagtacgaaaccgagaccgagaacgacggaccggaggaaccgacggtcgttacggttagttaacttacggtcggtacggtacggaaaggtaacggacgttaacgtttaacgtttaaccgtaccgggtaacccggtaacccgttacgtttacgtttacg

SEQ ID NO: 344906 - DNA, 664 bp, Homo sapiens
  misc_feature: GZ8MTXP02GR16F.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggagcctggtcaagccgtgggggtccctgagactctcctgcgcagcctcgtggacttctaccttcagttagttatagctatgtaacgtcgggtccgccgaggcctaccggaggggaaggggctggaggtgggtctcatcctaattagtaagtaaatgtccgacctacgagactactacgcagactacacgtaggaaacgggcccactccaaccgtaattcccgaaccaaggacaaacccgtaaacgacccgaaaagaaccctcgaaacttggtaactcgtacgaactaaaagtcgaaaaccgacgtaccctagggaacgacgggaacccggaaggttaccgaaccgggtcttacggtagttaacgttccggaggacggacggaacggtaggtaacgttaacgtttaacgttacgtaacccggtaacccggaacccgttgtttacggtttacg

SEQ ID NO: 344907 - DNA, 740 bp, Homo sapiens
  misc_feature: GZ8MTXP02G0S72.11.27.C05.1.454.CMB.2.raw
  modified_base (268)..(268): a, c, t, g, unknown or other
  misc_feature (268)..(268): n is a, c, g, or t
  modified_base (320)..(320): a, c, t, g, unknown or other
  misc_feature (320)..(320): n is a, c, g, or t
  modified_base (674)..(674): a, c, t, g, unknown or other
  misc_feature (674)..(674): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagcgtggtggaggtcgtgggggaggcctgggtcaaggccggtcggggggtccctggacgtactcctcctgccgnacgcctcgtggcttccacccttcagtagttatagcatacgacgtgggtcccnccgaggtcctaccggaggggaacggggcgtagggaggttcgggtctacgtactaccgtaagtttaggtaagtaatcggtaccgtaccctaagagtactaacgtaccgacacgtaccttcgacctagggaaccgggaccacctccgaaccctagaccctacccgaaggaacccgaacccgtaaacgaccgaaaacgtaaccttccgaaaccgttggtaaacctaccgttaagaaacctaaaagtaccgaaacggaaacctcccggaaaggaaccgaacggggacccggtaaaggacccgtaacgggtctttaacggttaggtaaacctttcgtacgggtagaccggaaacggggntaaacggtaaccttttaggtaacgttcccggttaacccgggaccccttaagtttcggttttaaccg

SEQ ID NO: 344908 - DNA, 637 bp, Homo sapiens
  misc_feature: GZ8MTXP02GCYLM.11.27.C05.1.454.CMB.2.raw
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (438)..(438): a, c, t, g, unknown or other
  misc_feature (438)..(438): n is a, c, g, or t
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgcncagcctctggattctaccttnagtagttatagcatagaacgtcggtccgcgaggtctacggagggaaggggtcgtaggaggttcgggctacgatacctaagtttagtaacgtaaatgtcgtacctaacgtagacttaacgtacgacagtactacgacctaggaaccggggccaacgtcaaacctntccacaagagaacacgaccgtaaanaacttcactgtaaacncgtagaacaaaagtcgaaaactacggaccaggaagaccgggaacgaacgggttacgaaacgggttctaggttacgttaagtacgtggacggacggtagaacggtattaacgttaaacgttaccgttaccggtaacccgggtaactatttacggtttac

SEQ ID NO: 344909 - DNA, 751 bp, Homo sapiens
  misc_feature: GZ8MTXP02HJVCK.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctgggtggaggtcggtgggggaggccgtggtcaaggccggtcggggggtccctgagactctcctgccgcacgtcctcgtcggtattcctaccttctaggttagttatagactagtacgaacgtcgggtacccgccgacgggtaccgtaccggggaaggggggaacgggggtccggtaggggtaacggggttcggggtaccttaccgtaaacgttaccctaaagttttaaaggttaaagtttaaaacgttaggtacccgtacccgtaaacgtagtaacttaccgtaaccgacacgtaccgttacgaaccggtacgggaaccggggtccccgaaccttaccccgaacccttactaccgtacccgaaaggaaccgaacccgaaaccgaaccgaaaacgtaacctacgtaccttagttactacgtacgtactaaaactagaaaccgacgtaccgtaggaggaccggacggaacgtacggacgtgttcggtattagtcgtaggtcgacggaacggagtagtaacttacgtacgtcggtaccgaccgttagttacgtttag

SEQ ID NO: 344910 - DNA, 616 bp, Homo sapiens
  misc_feature: GZ8MTXP02IYVME.11.27.C05.1.454.CMB.2.raw
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgcttattttagaaggtgtccagtgtgaggtgcagctggtggaggtcgtgggggagcctggtcaagccgtgggggtccctgagactcctctgcgcagcctntgtattcaccttcagttagttatagcagtcgaacgtcgggtcccgccgaggcctccgaggggaaggggcgtggngtgggtctcatacctagtttacgtaagttaagtagtccgaccgtaacagactaacgtacgcagtactcacgtaggacggaccgactccaacactccacgaacgacgaacaaccgaccaaagtacctacacgtagttactctacgaactaaagtcgaaacacgtcctagacgagccggagaccgcgtacttaggtcttaaagtttcgtacggtacggacgtaaacggaggacttaacgttaagtttacctcggaaccggtaaacccgtgttacgtttttacg

SEQ ID NO: 344911 - DNA, 669 bp, Homo sapiens
  misc_feature: GZ8MTXP02JZN3L.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgtctattttagaaggtgtccagtgtgaggtgcagcgtggtggagtcggtgggggaggccgtggtacaaggccggtggggggtccctggacgactctcctgcgcagccctcgtggtacttcctaccttcgagttagttatagcatagacgtcgggtccgccgacggcctccggaggggacggggtcgtgggtacggttgggtcctacactaccgtaagtttaagtaagtaatagtcgacctaacagtaactacctacgctaccgactaccgtacgtagggaaccgggcccgtaactcccaacccgtacttacccgaccgaaacggaacgaaacccaacccgaacccaaaacggtaaccctacgtacgtacgttataccgtacgaactaaagacgaaaccgacgcccgtaaggacggaaccggcggtaacggaccgtacggtacgtgttacgtattaccggtgtcgagtacgagtatcgtagtactacgtaccgaccgtatcgtttacg

SEQ ID NO: 344912 - DNA, 635 bp, Homo sapiens
  misc_feature: GZ8MTXP02GBRC5.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagttagttatagcatgaacgtcgggtccgccgaggctccggaggggaaggggcgtgggaggtggggtctcatccgtaatttaagtaagtaaagtagtacgaccctaacagatactacgacagactcacgtgaacggggccactcaaccactcctcagacgaaccaaacgaccaaagaactcactagtaactctagaacaaagtacgaaacacgtaccctggaacgacggaacccggaacgggtaccgaacggggtccttaggttacgtttaagttaaccggttggtacggacggaaaggacgggtaagtaacgttaagttaacgtaccgtaaccgggaaaccccgtagttcggttttacg

SEQ ID NO: 344913 - DNA, 764 bp, Homo sapiens
  misc_feature: GZ8MTXP02GYDZG.11.27.C05.1.454.CMB.2.raw
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtggaggtgcagcgtggtggagtcgtgggggaggcctggtcaagccgtgggggtccctgagactctcctgcgcagcctntggacttccacccttnagtagttatagcaagtgaacgtcgggtccnccgaggcctccggaaggggaacggggtcgtagggaggttggggtcctacgtacttcctaaagtttaaggttaagttaaagttacggtaccgacccttaacgaagtaacttaaccgtaccggacacggtacctaccgtaaccggttacgggaaacggggtccccgaaacttccccaaaccctacttacccgtacccaaagggaaacgaaaacccgaaaacccggaacccaaaacggtaaacccttaccctaacgttacggtttactaccgtttacggaaacctaaaagtaccgaaacgtacgacccgtaggaacgacggacccggaacggaaccgacggtacgttaggttaccgttaagtttacgtcgggttaggacgggaaggtaggggtactaaccgtttaagtttaaccgttccggtaaccgggaaaaccccgtttgttacggtttttacgg

SEQ ID NO: 344914 - DNA, 676 bp, Homo sapiens
  misc_feature: GZ8MTXP02FQ84I.11.27.C05.1.454.CMB.2.raw
  modified_base (373)..(373): a, c, t, g, unknown or other
  misc_feature (373)..(373): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagttatagcatcgaacgtgggtcccgccgaggcctaccggaggggaaggggcgtggaggtgggtctcactcctagttagtagtaatgtcgacctanagtatactacgcagactactacgtaggaacgggccgtactccaacctactaccctaccaagacgaaccaaaccggacccaaaacggtaacctccgaaacttcgttaacttcgtaacgaactaaaacgtacggaaaacccgacgacccgttaggaaaccggaaccgggaccggaaacgggaaccgtaacgggtcgttacggttagttaaccgtttaacggtggtacggtaccggaaggtaaggtacgtaaccgtttaagttaaccgttaccgtaccggtaaccccgttagtttcggttttaacg

SEQ ID NO: 344915 - DNA, 622 bp, Homo sapiens
  misc_feature: GZ8MTXP02H887G.11.27.C05.1.454.CMB.2.raw
  modified_base (252)..(252): a, c, t, g, unknown or other
  misc_feature (252)..(252): n is a, c, g, or t
  modified_base (356)..(356): a, c, t, g, unknown or other
  misc_feature (356)..(356): n is a, c, g, or t
  modified_base (551)..(551): a, c, t, g, unknown or other
  misc_feature (551)..(551): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaaggtgtccagtgtgaggtgcagctggtggagtcgtgggggagcctggtcaagccgtgggggtccctgagactctcctgcncagcctctggattcaccttcagtagttatagcatgaacgtcggtccgccgaggcctccggaggggaagggcgtggagtcgggtctcatcattagagtaatagcncctacagactactacgcagactcacgtaggacgggcccgactaccaccctatccaccgaagacgaaccctaaccggaccaaagaacctacacgtacgttattccgtagaaactaaaagtacgaaaccgtacgacccgtagggacgacggaccggaaacgggtaccacggggtacttggtacgtttagtttacggnggtacgacggaaggtaggtactaagttaacgttacgtaccggtaacccggtaaccttagtttacgtttacg

SEQ ID NO: 344916 - DNA, 685 bp, Homo sapiens
  misc_feature: GZ8MTXP02HEG02.11.27.C05.1.454.CMB.2.raw
  modified_base (498)..(498): a, c, t, g, unknown or other
  misc_feature (498)..(498): n is a, c, g, or t
  modified_base (624)..(624): a, c, t, g, unknown or other
  misc_feature (624)..(624): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctcgctgggttttccttgttgctattttagaaggtgtccagtgtgaggtgcagctggtggagtcgtgggggaggcctggtcaagccgtggggggtccctgagactctctgcgcagcctctggattcaccttcagtagttatagcatgaacgtcggggtccgccgaggcctaccggaaggggtaaacgggggccgtagggaggttggggtcctacgactccgtaagtttaagttaaagtaaagtaggttaccggacccttaaacgtaggtaaaacttactaaccggactacgggaccttacgaacgtacggaaaaccgggggccccaaccgttccaacccaattcccaccgaacgganaacccaaacggacccaaaacgaacctaccaaaccttgtaaacttctagaacctaaaaggcaaacgacgacccgtaggaacgacggacccggaaggtaaccgacggtcttcggtaggttattaacgnggttcgacgaggtaaggacgtccttaattacgtcttaacgggaccccagtttacgtttcgg

SEQ ID NO: 344917 - DNA, 520 bp, Homo sapiens
  misc_feature: GZ8MTXP02FQKV5.11.27.C05.1.454.CMB.2.raw
  modified_base (511)..(511): a, c, t, g, unknown or other
  misc_feature (511)..(511): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgcgcagcctctggattcaccttcagtagttatagcatgaactgggtccgcctggctccagggaaggggctggagtggggtctcatccattagtagtaatagtgcctacagatactacgcagactcactgaagggccgactcaccatctccagagacaacgccaaagaactcactgtatctgcaaatagaacagccctgagagccgaggacacggctgtgtattactgtgcgagaggagcgtattactctacggaaccccgntacggtttc

SEQ ID NO: 344918 - DNA, 532 bp, Homo sapiens
  misc_feature: GZ8MTXP02IOPE1.11.27.C05.1.454.CMB.2.raw
  modified_base (363)..(363): a, c, t, g, unknown or other
  misc_feature (363)..(363): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccgccaggctccgagggaaggggctggagtgggtctgatccattagtagtaaatagtcgacctanagatactacgcagtactcacgtgacggggcactcacatctcagacgacaacgccaaagaactacactgtatctagacaatagaacagcctagacgagcgaggacgacgcgtagtagtatcgtgtcgcgagagagtaatacgttatacgtacgaacccgagtcgtttacg

SEQ ID NO: 344919 - DNA, 985 bp, Homo sapiens
  misc_feature: GZ8MTXP02GE2NV.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagcgtgggtggagtcggtgggggaggcctgggtcaaggccgtcggggggtccctggacgacctctcctgcgcacgcctctggtacttccaccttcaagttagttatagactatacggaacgtcggggtccccgaccgacggtcctaccgggaagggggaacggggtcgtaggggacgggttcggggtacctacgtacgttccgtaaagtttaaggtaagttaaacgttacggttacccggaaccctaaacgaacggtaacttaaccggttaaaccggacgtacggtaaccttaccgaaccgggttaacggggaaacccgggggtacccctacccgttacccgaaacccctacgtttaaacccccgaccggaaaacggaaaaccggaaaaccccgtaaaacccggaaaccccggtaaaaacgtaaaccccttacccgtaaaaaccgtttggttaaaacccttccggtaaataaaaacccgtaaaaggttaaacccgggtaaaaacccgtacccgggtaaacccggtaaggggaaaaccgggtaacccgggggaaaccgggtaaaccggggtaaacccggttaccgggggttacggtttaaacgggtttaaaccggttttaacggttttaacggtacggggtacggggttaaaccggggtaaaacgggggttaaaccggggttaacgtttaaacccggtttaaaacggtttttaaaaccccggtaccccgggggtttaaaacccccgggggttaaaaccccctttacggggtttttaccggtttttttaaacggg

SEQ ID NO: 344920 - DNA, 665 bp, Homo sapiens
  misc_feature: GZ8MTXP02HE7M5.11.27.C05.1.454.CMB.2.raw
  modified_base (375)..(375): a, c, t, g, unknown or other
  misc_feature (375)..(375): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaacgtcgggtccgccgaggcctccgaggggaaggggcgtggaggtgggtctcgactcctaattagtaagtaaatagtcgacctanagatactacgcagacctcaacgtggaaacgggtccgactacccaaccctacgttccctaccgaagacgaaaccgaaaccgacccaaaagaacctaccgtaactacgttaactccgttaagaacgtaaaatacggaaaactacgacccgttagaacggaacggaccggaacgggaaccgtaacgggtcttacggttacgttaaactttacgtaggtacggacggacggaaggggtaacgtcgttaaattacgttacgtaaccgggtaaacccccgtagttcgttttaacgg

SEQ ID NO: 344921 - DNA, 729 bp, Homo sapiens
  misc_feature: GZ8MTXP02I711P.11.27.C05.1.454.CMB.2.raw
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtggggggtccctgagctctctgcncagcctctggattcctaccttcagttagttanagctatagaacgtcgggtcccgccaggctccggaaggggagggcgtggaggttgggtcctcgtattcctagttaagttaagtaaagttaggtaccgtacccttaacgaagtaaacttaaccgtaaccgtacacggtaccttaaccaacgttacgggaaacggggcccctaaaccgtaccaaacccctattacccgtacccaaagggaacaaacccgaaaaccgaccccaaaaggaaccctccgaaaccttgtaacctaccttagaaacctaaagtaacaaaccggaccgtaccgtagggaaggaccggaccgggaacggaaccgtaaccggggttctttacggttagttaacgttacggtaggtacggaacgggaacggtacggtaataacgttaacgtttacgtacccggttaaaccggtacccgttagttacggttttacg

SEQ ID NO: 344922 - DNA, 572 bp, Homo sapiens
  misc_feature: GZ8MTXP02FQT3K.11.27.C05.1.454.CMB.2.raw
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagtagttatagcatgaactgggtccncaggctccgagggagggctggagtgggtcncatccattagtagtaatagtcgcctacagtatactacgacngactacacgtgaacgggccgactccaccatcctaccgagacaacacgaccaaagactcactgtatcctagacaaatcgaaacngaccctgaacgacggccgaaggaaccncgggtaccttggtacgttattacgtggtacggacgtaaggaggtacgaattaagttacgtacgtaccggaaaccccgtagttcgtttacg

SEQ ID NO: 344923 - DNA, 658 bp, Homo sapiens
  misc_feature: GZ8MTXP02I3JIO.11.27.C05.1.454.CMB.2.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (564)..(564): a, c, t, g, unknown or other
  misc_feature (564)..(564): n is a, c, g, or t
  modified_base (592)..(592): a, c, t, g, unknown or other
  misc_feature (592)..(592): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgtttgcttattttagaaggtgtccagtgtgaggtgcagctggtggagtcgtgggggacgcctggtcaacgccgtgggggtccctgacgactctcctgcgcngctctgatcactcagtagttanagctatgaacgtcgggtccgaccgaggtcctccggaaggggaaggggtccgtaggggacggttcgggtcctaccgtacttacctaaagtttagtaagtaaagttagtaccgaccctaagagtaacttaccgaaccgtcacgtaccttaccaacgtacggaaccgggtacccaccgttaccaaccctagttcccaacgaacggaacaaaccaaacgacccaaagaacctacacgtagtatactagacctaaagtagaaccacgtccaggacggacgacgganaccgacgtcttacggtgttaacttacgnggttacgccggaaaggagtacgtaacttacgttacgtaccgacgtaccgtacgtttacggtttacg

SEQ ID NO: 344924 - DNA, 635 bp, Homo sapiens
  misc_feature: GZ8MTXP02IHOKM.11.27.C05.1.454.CMB.2.raw
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (471)..(471): a, c, t, g, unknown or other
  misc_feature (471)..(471): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaggtgtccagtgtgaggtgcagctggtggaggtcgtggggggaggcctggtcaaggccgtggggggtcccctggagactctcctgcgcagcctctggatttcaccttcagtagttatagcatgaactgggtccgccaggcctccgaggggaacggggcgtggagtgggtctcactccattagtatanagttcgcctanagatactacgcagactacacgtgaacggggccgactccaccgatcctaccagacgacaaccgcccaaagaacctcactagtactacctagactaaaacgnaaacgacgcccttaggacgaagccccggaaggaaccgacgggacgttaggttagtaacctttacgttagggttcggaccggaaaacggaggttaacggtaactttaaacggtttaacttacccgggtaccggtaaaaccccccgtgtttaaacgggttttcccg

SEQ ID NO: 344925 - DNA, 589 bp, Homo sapiens
  misc_feature: GZ8MTXP02HK5LI.11.27.C05.1.454.CMB.2.raw
  modified_base (366)..(366): a, c, t, g, unknown or other
  misc_feature (366)..(366): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctgattccaccttcagtagttatagcatgaacgtgggtcccgccaggctccgaaggggaaggggcgtggaggtgggtctcatcctattagtataaatgtgcctanagatactacgacagactaccactaggaacggggcccactaccaccactcctaccgaagacgaacaaccgaccaaagtaactacacctgtactcgtagactaaaagtgaaaactacgccctaggagacggaccggaagaccgacggtctggttactattacgtggtcgacggaggaaggacgtgttattaacgtccggtacggtaaccccgagtttcgtttacg

SEQ ID NO: 344926 - DNA, 619 bp, Homo sapiens
  misc_feature: GZ8MTXP02FK287.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcacgcctctggattcacttcagtagtatagcatgaactgggtcccgccaggctccgaggggaaggggcgtggagtgggtctcatccagttaagagtaaatagtcgacctacagatactacgctagactcaacgtggaaaggggtcccaactcccaaacctactcctaccaacgaacgaaccaaaccgaccctaaaagaaacctacgaactgtaaactctagactaaaagtacgaaaaccacgacccgtagaaggacgaccggaaggacgacggtacttcggtattaagtttacgtaggtcggacgaagaggggtaacaaccttaaagtacgtacgtaccggtaaaacccctagtacgttttacg

SEQ ID NO: 344927 - DNA, 618 bp, Homo sapiens
  misc_feature: GZ8MTXP02FGVMN.11.27.C05.1.454.CMB.2.raw
  modified_base (407)..(407): a, c, t, g, unknown or other
  misc_feature (407)..(407): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggaggcctggtcaagcctggggggtccctgagactctcctgcgcagcctctggattcaccttcagtagtatagcatgaactgggtccgccaggctccgagggaaggggctggagtggggtctcgatccatttagagtaaatagtcgcctacagatactacgacagactcactgaagggccgactcaccatctccaganacacgccaagaactcactgtatctagacaaaagtacgaaacagtacccgtgaacggaacggacccgggaaaggacccgaacgggtaccttacgggtaggtttaaactttaaccgtggttacgggaccggtaacgggaggggtaaacggaaccttaaagtttaacgtaccgtttaaccgggggaaaacccccctaaggtttcgtttaaccgg

SEQ ID NO: 344928 - DNA, 668 bp, Homo sapiens
  misc_feature: GZ8MTXP02GBRDB.11.27.C05.1.454.CMB.2.raw
  modified_base (288)..(288): a, c, t, g, unknown or other
  misc_feature (288)..(288): n is a, c, g, or t
  modified_base (435)..(435): a, c, t, g, unknown or other
  misc_feature (435)..(435): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcctaccttcagttagttanagcatgaacgtcgggtcccgccgacggctaccggaggggaacggggcgtgggaggtcgggtctactatcctagtttaagtaagtaagtagtccgacctacagtatactacgacacgactcacgtaggaaccggcgacctcaaccctntccctacaagacgaaccaaaccgccaaaacgtaactcactgtaactcttagaacctaaagtcgaaacacgacccgtagggaacgaccgggaaccggacggaaaccgtccgggtacgttaggttaacgtttaaccgttacgttgggaacgggtaccgtaaacgggaggtacgttaaacttaacgtttaaccgaccggttaacccggaaaccccgttgtttaccggtttttaccg

SEQ ID NO: 344929 - DNA, 574 bp, Homo sapiens
  misc_feature: GZ8MTXP02IEC4K.11.27.C05.1.454.CMB.2.raw
  modified_base (446)..(446): a, c, t, g, unknown or other
  misc_feature (446)..(446): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggtggagtcgtgggggaggcctggtcaagccgtggggggtccctgagactctcctgcgcagcctctggattcaccttcagtagttatagcatgaacgtcgggtccgccgaggctccgaggggaaggggctgggagtggtctcatccattagtagtaatgtgccctacagactactacgcagctccactaggaacgggcccgactccgacctactctccaagacaacaacgaccaagaactcaactagtntactagacaaatcgaaacagccctagaacgacggccgaaggaccgaacggctagtagttacttacgtgtaggacggagaggacgtacttaagtacgtcgtacggaaacccctgtcggttacttttagg

SEQ ID NO: 344930 - DNA, 751 bp, Homo sapiens
  misc_feature: GZ8MTXP02JP5I5.11.27.C05.1.454.CMB.2.raw
  modified_base (264)..(264): a, c, t, g, unknown or other
  misc_feature (264)..(264): n is a, c, g, or t
  modified_base (684)..(684): a, c, t, g, unknown or other
  misc_feature (684)..(684): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggccgtggtcaaggccgtgggggtccctgagactctcctgcgcagcctntggtattccaccttcaggttagttatagctagtacggtaacgtcggggtccccgacccgagggcccttacccgggaaagggggaacgggggtccgttaggggacgggttcggggttaccttacgaccttaccgtaagttttaaaggtaagttaaagttacggtccgtaaccccgtacgtaaggtaacttaccgtaaaccggcctaacgggtccttacgaaaccggttacggggaaaccgggggtccccgtaaccttcccgaaaacccttttaccccgtaacccgaaaggaccaaaaccccgaaaccgtacccgaaaaagtaccctcgaccttagtaaccttcgaacgaaacctaaaagtcggaaactcgaccgtagacgtcggaccaagggtaccagtcgttaggtcgttactacggtgngggaccggtaagtcggtaaattcttagtaacgtccggaaaccggtaacccttggttcgttttaacgg

SEQ ID NO: 344931 - DNA, 562 bp, Homo sapiens
  misc_feature: GZ8MTXP02F75OB.11.27.C05.1.454.CMB.2.raw
  modified_base (302)..(302): a, c, t, g, unknown or other
  misc_feature (302)..(302): n is a, c, g, or t
  modified_base (355)..(355): a, c, t, g, unknown or other
  misc_feature (355)..(355): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (508)..(508): a, c, t, g, unknown or other
  misc_feature (508)..(508): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtcctgagactctcctgcgcagcctctggattcaccttcagtagttatagcatagaactcgggtccnccaggctccgagggaaggggctggagtgggtctcatccattagtagtaatagngacctacagtatactacgcagactcattagaacggggccacgtccacatctcaagacacaacgccaaagactnactgtaanctagacaaagtnaaacagcctagagacgaccgaggacnccggatcgtagttactacgtagtcggacggtagngggactaacttacgttaacgttacgtaccgaaaaccccgtgtttacgtttccgg

SEQ ID NO: 344932 - DNA, 671 bp, Homo sapiens
  misc_feature: GZ8MTXP02H121S.11.27.C05.1.454.CMB.2.raw
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (517)..(517): a, c, t, g, unknown or other
  misc_feature (517)..(517): n is a, c, g, or t
  modified_base (607)..(607): a, c, t, g, unknown or other
  misc_feature (607)..(607): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttgggttttccttgttgcttattttagaaggtgtccagtgtgaggtgcagcgtggtggaggtcgtgggggacggtccgtggtacgaaggcccggttgggggggtccctggacgtactccttccgtgcgcacgccctgtggtacttccacccttgaagttagttanacgctaatagaacgtgggtcccgaccgaggccgtaccgggaggggtacggggcgtggggaggttcggtctacactacctaagttagtaagtaataggtccacctaanagtactactaccganacgacctnaacgtacggaaacgggcccctaactcccaaaccctatcccgacaaaacggacaaaccccgtaacgaacccgaaaanacctactcttagtaacttctaagaactaaaagcgaaacgcgaccggagaacgcggaacccgggagtaccggacgagtttgtaaacgtttntaacgtggacgagaacgtaggattaaccgtattaacgtccgaacggtaccctgttaggtttacg

SEQ ID NO: 344933 - DNA, 560 bp, Homo sapiens
  misc_feature: GZ8MTXP02FG25T.11.27.C05.1.454.CMB.2.raw
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
  modified_base (505)..(505): a, c, t, g, unknown or other
  misc_feature (505)..(505): n is a, c, g, or t
  modified_base (516)..(516): a, c, t, g, unknown or other
  misc_feature (516)..(516): n is a, c, g, or t
  modified_base (537)..(537): a, c, t, g, unknown or other
  misc_feature (537)..(537): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggaggcctgggtcaagcctggggggtccctgagactctcctgcgcagcctctggattcaccttcagtagtatagcatgaactgggtccncaggctccgaggggaaggggctggagtggggtctcgatccctaatttacgagtaacttaggtcgacccttanacgattacctacgcagaactcactgaaggtccgactcaccatacctaccagagaaccaacgccaaagtaaacctcaactgtaatcctagacaaaatcgaaaccaggccctagacgacggccgaggaccacggtcngtgtattacgngtacgcgagagtagctattancgtacggaaccccgatcgttacg

SEQ ID NO: 344934 - DNA, 628 bp, Homo sapiens
  misc_feature: GZ8MTXP02IOAZ5.11.27.C05.1.454.CMB.2.raw
  modified_base (382)..(382): a, c, t, g, unknown or other
  misc_feature (382)..(382): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattccaccttcagtagttatagcatgaacgtcgggtccgccgaggcctccggaaggggaacggggcgtgggaggtggggtcctcactcctagttaagtataaagttgtaccgacctanagtaactactaccgcacgactacacgtagaacggggcccaactcacctatcctaccagacgaaccaacgaccaaacgaactcactgtactctagaaccaaaatgaaacgacgtccgaggacggaacggacccgggaaaggacccgtaacggccgttagttaggtttactttaaccgtgtacggacggtaggacggagtaaccgtttaagtacgtaccgtacgggaacccccgtagtttcgtttacg

SEQ ID NO: 344935 - DNA, 620 bp, Homo sapiens
  misc_feature: GZ8MTXP02F7ZV0.11.27.C05.1.454.CMB.2.raw
  modified_base (304)..(304): a, c, t, g, unknown or other
  misc_feature (304)..(304): n is a, c, g, or t
  modified_base (465)..(465): a, c, t, g, unknown or other
  misc_feature (465)..(465): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggacttcaccttcagttagtatagcatgaacgtgggtcccnccgaggctccgaggggaaggggctggaggtcgggtctcatcctattaagtagtaaattagtcgacctacgagatactacgcagactcaacgtgaaccgggccactaccaccatcctaccaagacaaccgaaaccgaccaaagaacctcactcgtatcgtanacaaatacgaaacacgccgtaggagaaccgggaccggaacggaacgaccgggtctaggtttacgtaaacgtttacgtggtaacggcgaaaaggggagtaacgtaactttaacttaacgtaccggtaccggaaaaccccgtgtttcggttttaacg

SEQ ID NO: 344936 - DNA, 648 bp, Homo sapiens
  misc_feature: GZ8MTXP02J0MAG.11.27.C05.1.454.CMB.2.raw
  modified_base (398)..(398): a, c, t, g, unknown or other
  misc_feature (398)..(398): n is a, c, g, or t
  modified_base (580)..(580): a, c, t, g, unknown or other
  misc_feature (580)..(580): n is a, c, g, or t
  modified_base (640)..(640): a, c, t, g, unknown or other
  misc_feature (640)..(640): n is a, c, g, or t
tcagcgagagataccacgaccggtgctcgatttagacgcgatcgaagggtttgggggagagaggagccttagccctggattccaaggccctatccacttggtgatcagcactgagcaccgaggattcaccatggaactggggctccgctgggttttccttgttgctattttagaaggtgtccagtgtgaggtgcagcgtggtggagtcgtgggggaggcctggtcaaggccgtgggggtccctgagactctcctgcgcacgcctcgtggtacttcctaccttctagttagttactagactagtagacgtcgggtccgccgaggtccgtccgggaaggggacggcgtgggacggtcggtctgtactactagttaagtaagtagtagtacccgtacctanagtaactacgtacacgacgtacctacgaacggtacgaaccggtaccgacctaccaacactccacgaagaacggtaaaccaccgaaccgaaaactacctacgtacgttataaccgtaccgtaagaaactaagacgaaaccgtcgaccgaggaacgtacggaccggacgacacggtgtttacgntttaacgtcggtgaacggactagggactagtaacctagtacgttacgaccggtaccgttnttcgttcg

SEQ ID NO: 344937 - DNA, 607 bp, Homo sapiens
  misc_feature: GZ8MTXP02GTPKX.11.27.C05.1.454.CMB.2.raw
  modified_base (290)..(290): a, c, t, g, unknown or other
  misc_feature (290)..(290): n is a, c, g, or t
  modified_base (535)..(535): a, c, t, g, unknown or other
  misc_feature (535)..(535): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagcgtggtggagtcgtgggggaggcctggtcaagccgtggggggtccctggagactctcctgccgcagcctcgtggattccaccttcagtagttanagctatgaacgtgggtcccgccgaggcctccggagggggaacggggcgtggggaggtcgggtctcattcctaatttagtaagtaagttgccgacctacagaactactaccgacacgactacaacgtggaaacgggcccactaccactatccacaggacaaaccacgacccaaagaacctccatcgtaaatctagaactaaagtcgaaacgtacgccgtagaacggacgccggagtaccgacggtntaggttatactcgtgacggacgaggaggactgttattaccgtacgtacccggaacccgttattccgtttacg

SEQ ID NO: 344938 - DNA, 809 bp, Homo sapiens
  misc_feature: GZ8MTXP02IEBH9.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttggttttccttgttgcttattttagaaggtgtccagtgtgaggtgcagcgtggtggaggtcggtgggggagccgtggtcaaggccggtgggggtccctgacgtacctcgtcctgccgcgacgcccttcgtggtacttacctaccctttagaagttagtttagtagctagtacggtaacggtcggggtaccccaccggacggtcccgttaccggggaaggggaacggggtcgtaggggtacggttcggggttcctacgacgtttaccgtaaagtttaaggttaaacgttaaagttacgtacccgtaccccgtaaagtaacgtaacttaaccgtaacgacacgtaaccctacgtaaccggtaagggaaacccggggccccaattaccccgaaccttacgaccctaccgaaggaaccgtaaacccgaaaccgaaccgaaactaaacccgtctaaaccgttgtaaaccttacgttacgaaaacttaaacgtaacgaaccgtcgtaacccggtagggaaccgaccgggacccggtaacggacccggtccggttagtttacgttagttaaccgttacgttgggcggaacgtaacgggtacgtacgttaacgtttacgttaaaccgtcccggtaaaacccggttacccgttgtttaccggttttccgg

SEQ ID NO: 344939 - DNA, 627 bp, Homo sapiens
  misc_feature: GZ8MTXP02I239Y.11.27.C05.1.454.CMB.2.raw
  modified_base (309)..(309): a, c, t, g, unknown or other
  misc_feature (309)..(309): n is a, c, g, or t
  modified_base (557)..(557): a, c, t, g, unknown or other
  misc_feature (557)..(557): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaagccgtggggggtccctggagactctcctgcgcacgcctctggacttcacctttcagtagttatagcatggaacctgggtcccnccaggcctccggaggggaaggggctaggagtgggtctcatccagtttagtagtaaatagtcgacctacagaactacgtaccgcacgactcacgtagggaacgggccacgtccaacccatcctacccaagacgaaacaacgacccaaagaacctcgacctgtactccgtagaacctaaatcggaaacagtcccgaagacggacgaccgaagggtaccaacgggtccttagggttacttaagtttaccgnggtacggacgaacggtaggaactaacgttacttaacggtaccggtaaccgaacccgttgtttacgttacg

SEQ ID NO: 344940 - DNA, 537 bp, Homo sapiens
  misc_feature: GZ8MTXP02FFYW8.11.27.C05.1.454.CMB.2.raw
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttactattttagaaggtgtccagtgtgaggtgcagctggtggagtctgggggaggcctggtcaagccgtggggggtccctgagactctcctgcgcagcctctggattcaccttcagtagttatagcatgaactgggtccnccaggctccagggaaggggctggagtggggtctcatccatttaagtagtaataggtcgacccctacagatactacgcagctcactggaaggccactcaccatctccagagacaacgccaaagaacncatgtatctagacaaatagaacagctgagacggccgaggacacggactgtagtattacgtgtgcgagacgacgataattactacgtacgaaccccgtatcgtcttttacgg

SEQ ID NO: 344941 - DNA, 679 bp, Homo sapiens
  misc_feature: GZ8MTXP02HGVSC.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcacgcctctggattcaccttcagtagttatagcatgaacgtcgggtccgccgaggcctccggaaggggaaggggcgtgggaggttggggtctacgactcctagttaacgttaagtaaataggtccgacctaacagtactaccgtaacgcagacctacgaacgtacggaacgggcccgaacttcccgaaccctactacccgtaccgaacggaacgaacccgaaacccgaacccaaacgaaccctacaacgtacgttaactcgttacgaactaaatacgaaaccacgacccgtaggaacgacggaccggaacggacgacggtacgttagtacggttaactttacgtaggtacggacggaacggtaagggtaacgtaacgttaagttacgttacccgttaccggaaccccgttagttccgttttacg

SEQ ID NO: 344942 - DNA, 660 bp, Homo sapiens
  misc_feature: GZ8MTXP02GSVCW.11.27.C05.1.454.CMB.2.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctntgattcaccttcagttagttatagcatgaactgggtccncaggcctccgagggaagggctggagtgggtctcactccagttagagtaaatgcncctacagactacgtacgcaggactacacgtagaacggggcccaactcaaccactcctacccaagacgaaccgaaaccgaccgaaacgaacctacaacctgttaaactcgtacgaacctaaaagtacgaaaccgagtacccaggaacggaacggacccggaacgggaacccgacgggccgtttacggtagtttaaactttaccggtaggttacggaccggaaacgggacggtaagggtaacgtttaaaactttacgttaacccggtaccgggtaaaacccccgtaagtttccggtttttaaaccgg

SEQ ID NO: 344943 - DNA, 601 bp, Homo sapiens
  misc_feature: GZ8MTXP02GXSZS.11.27.C05.1.454.CMB.2.raw
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (465)..(465): a, c, t, g, unknown or other
  misc_feature (465)..(465): n is a, c, g, or t
  modified_base (564)..(564): a, c, t, g, unknown or other
  misc_feature (564)..(564): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggtttccttgttgctattttagaaggtgtccagtgtgaggtgcagctggtggagtcgtgggggagcctggtcaagccgtgggggtccctgagactctcctgcgcagcctcgtggtattcaccttcagtagttatagcatgaactgggtccnccgaggctccgaggggaaggggctggagtgggtctcatcctattagtataaatagtcgacctanagatactacgcagactacacgtaggaacggggtacccaactcaacccactcctacccgaagacgaaccaaacgacccaaagtaaacctacaacctagttaancccttaagaacctaaaatagaaaccacgaccctaggaacgacggaccggaggaacgacggacgttcggtagttactacgtgtacggacggaagaggtanaacttagtactccgtacggaacccctagtctttacgg

SEQ ID NO: 344944 - DNA, 784 bp, Homo sapiens
  misc_feature: GZ8MTXP02GUQ4O.11.27.C05.1.454.CMB.2.raw
  modified_base (293)..(293): a, c, t, g, unknown or other
  misc_feature (293)..(293): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtggtggagtcggtgggggacgccgtggtacaacggccggtgggggtccctgacgtactcctccgtgcgcacgtcctcgtggacttcctaccttnagttagttatagcatgaacgtcgggtaccgccgaggccgttacggaggggaaggggcgtggaggttcgggtctcgtactacgtaaagtttacgtaagtaatcggtacgtacctaacaggtaactaaccgacgacacgtaactacgaacgtaggaaccgggggtccctaaacgtaccctaaccctactacccgtaccgaaacggaacgaaaacccgaaaccgggtaaaccctaaaacggtaaacccttaaccaaccgtttacgtaaacgttaccggtaaactaaacgtaaaacttaccgggaaaacgtacccgaacccgttaaggacggtaacccgggaaacccgggaccggaacgggtaccgggtacgtttaacgggttacgtttaacgttaaacggttccgggtagtacgggaaagggttaaccggtaaataacgtttaacgttacgttaccggaacccgtttaacccggtaggttttacgttttccggg

SEQ ID NO: 344945 - DNA, 836 bp, Homo sapiens
  misc_feature: GZ8MTXP02GS4SN.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagtcgtgggggtcctgagactctctgcgcagcctctggattcaccttcagttatatagcatgaacgtcgggtccgccgaggcctaccggaagggggaacggggctaggggaggttcggggttcctcgtactacccgtaagtttaaggtaagtaaagttaggtcccgtacctaacgaaggtaacttaaccgtacgctacggtacctaccgtaacgtaggggaaacccggggtacccaaccgttcccaaaccctacttacccgtacccgaaaggaaacccgaacccgtaaaacccgacccgtaaaacggaaacccttacctaaacgtttcggttaaaccttccgttaaacggaaaaccctaaaaagtttaccgggaaaaaaccgttaccggacccccgtttaaagggaaacggggaacccggaaccccggggtaaacgggaaaacccgtaacggggccctttacgggggtttaatttaaacgttttacccggtagggttaccgggtacgggaaaacggggtaggtaaacccggtttaagtttaaaaccgtttacggttaaaacccccgggtaccggggttaaaaaccccccgtgttttacccggtttttaaccgg

SEQ ID NO: 344946 - DNA, 599 bp, Homo sapiens
  misc_feature: GZ8MTXP02GG1YO.11.27.C05.1.454.CMB.2.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctgggtggagtcgtgggggaggccgtggtcaaggccgtggggggtccctgagactctcctgcncagctcngntcnctnagtatangnatagacgtcggccgcagctcgagggaggcgtggagtcggtctcactctagttagtagtaaatagtcctacctacagtactactacgacacgacctacacgtaggaacgggccgacaccaaccactccctacgaaagaacgaaccgaaacgaccctaaagaactccaactgtactacttcgaaacgaaaatacggaaaccacgaccgtaggaacgcggaaccggaagacgacggcgttagtacgttattacgtgacggacgaaggtagacgtcttaataacgttaccggaccggaaacccttggttctttaaccgg

SEQ ID NO: 344947 - DNA, 621 bp, Homo sapiens
  misc_feature: GZ8MTXP02FJBUX.11.27.C05.1.454.CMB.2.raw
  modified_base (276)..(276): a, c, t, g, unknown or other
  misc_feature (276)..(276): n is a, c, g, or t
  modified_base (542)..(542): a, c, t, g, unknown or other
  misc_feature (542)..(542): n is a, c, g, or t
  modified_base (611)..(611): a, c, t, g, unknown or other
  misc_feature (611)..(611): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggaggccgtggtcaaggccgtggggggtccctgagactctcctgcgcagcctctggattcaccttnagttagttatagcatagaacgtcgggtcccgccgagggcctacccggaaggggaaggggcgtgggaggtggggtctcatcctattaagagtaaactagtcgaccctacaagtataccgtaacgaccagactcaacgtaggaacgggtaccgactaccaacctatcccgtacaggaagacccaaaccgaccaaaagaaccctcactgtaatcctagacaaaagtcgaaaactacgacctaggaacgacggaccggaagaccgacggnttaggttacgtattacgtaggtcgacgaaggacggtagaacttaatacgttaccggacggaaacccgtntacgtttacg

SEQ ID NO: 344948 - DNA, 549 bp, Homo sapiens
  misc_feature: GZ8MTXP02HRYQT.11.27.C05.1.454.CMB.2.raw
  modified_base (342)..(342): a, c, t, g, unknown or other
  misc_feature (342)..(342): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
  modified_base (456)..(456): a, c, t, g, unknown or other
  misc_feature (456)..(456): n is a, c, g, or t
  modified_base (539)..(539): a, c, t, g, unknown or other
  misc_feature (539)..(539): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggtattcaccttcagtattatagcatgaacgtcgggtccgccgaggtcctccgaggggaaggggctgggagtgggtctnatcctaattagtaagtatagtcgcctaacagtaatactacgcagacctnactgaagggccactcaccntcctcagacgacaacgacaaagactacactgtactctgaacaaatnaaacagccagagacgcgaaggcacggctggtcttatacgtgtacgcgtagacggataactattacgtaccacggtaaccccgnttcgtttacg

SEQ ID NO: 344949 - DNA, 653 bp, Homo sapiens
  misc_feature: GZ8MTXP02FN1SC.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattccaccttcagttagttatagcatgaacgtcgggtcccgccaggcctaccgaggggaacggggctgggaggttggggtctccatcctaattaagtagttaaatagtcgacctacaagtactactaccgcagacctcaacgtaggaacggggacccgacctacccgaaccctacttccctacccaaagacggtaaacccaaaccggacccaaagaaaccctcaacttcgtaactctacgaacaaaatacgaaaccagtcccgtagacgacggaccgaaggaccgacgggacttaggtagttattacggtgtacggacggaaggaggtacgtaaccgtttaattaaccgttccggtaaccgggtaaccccgtaggttaccgttttacg

SEQ ID NO: 344950 - DNA, 648 bp, Homo sapiens
  misc_feature: GZ8MTXP02HBE8O.11.27.C05.1.454.CMB.2.raw
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaaggccgtgggggtccctgagactctcctgcgcagcctgnggtatcaccttcagtgttanagctatgacgtggtccnccgaggcctaccggaggggacgggcgtaggagtcggggtctcgtatacctagtttaagtaacgtaagtacggtaccgtcctaaacagtaacttacaccggcacggaccttacgaacgttagggaaccggggaccctactacccgactacttacccgtaccgaagggaaccaaccgaaaccgacccaaaacgtacctacaccgtagtactacgtagaacctaaaagtccgaaactaccgacgtagaacgacgtaccggaacggtacaccgggtatacgttagtaacgttcgttagacggaccgtagaggactaagttactacgtcgtaaccgaccgtagttacgtttacg

SEQ ID NO: 344951 - DNA, 604 bp, Homo sapiens
  misc_feature: GZ8MTXP02FJC3Z.11.27.C05.1.454.CMB.2.raw
  modified_base (286)..(286): a, c, t, g, unknown or other
  misc_feature (286)..(286): n is a, c, g, or t
  modified_base (398)..(398): a, c, t, g, unknown or other
  misc_feature (398)..(398): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttttccttgttgctattttagaaggtgtccagtgtgaggtgcagctggtggagtcgtgggggaggcctggtcaagccgtggggggtccctgagactctcctgcgcagcctctggattccaccttcagtagttanagcatgactgggccgcaggctccgaggggaggggctggagtgggtctcatccatttagtagtaatagttccctacagatactacgacagactcactaggaacgggaccgacncacccatcctccagacgacgaaaccgtacccaaacgaactcacgtatactactcgactaaatagaacgacgactacgaagacggacggaacggaccgacggtcgtaggttacttacgttaacgtggtacggacgaacgggagggaacgtacgttaagttacgtaccggtaccggtaacccccggtagtaccgttctttttaacggg

SEQ ID NO: 344952 - DNA, 609 bp, Homo sapiens
  misc_feature: GZ8MTXP02G71DI.11.27.C05.1.454.CMB.2.raw
  modified_base (257)..(257): a, c, t, g, unknown or other
  misc_feature (257)..(257): n is a, c, g, or t
  modified_base (544)..(544): a, c, t, g, unknown or other
  misc_feature (544)..(544): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctatttagaagtgtccagtgtgaggtgcagctggtggagtcgtgggggaggcctggtcaagccgtggggggtccctgacgactctccgtgcgcncgcctctggtacttcaccttcagtattatagcatgaacgtcgggtcccgccgacggcgtaccggaaggggaaggggcgtggaggttgggtctcgatccgtattagtaagtaatagtccgacctacaagatactacgcagactacgacgtagaacggccgactcaaacctctacccaccaaggacgaaacctaaaccgaccaaagtaacctacgactacgtactacgtacaactaaagacgaaacgacgtccaggacggaacgccgaggtacgacgcgttagacgttnttacggtggtaccgaggaacgngtanccgttaattaccgaccgtaacgaaccctgttccgtttag

SEQ ID NO: 344953 - DNA, 579 bp, Homo sapiens
  misc_feature: GZ8MTXP02GVR86.11.27.C05.1.454.CMB.2.raw
  modified_base (364)..(364): a, c, t, g, unknown or other
  misc_feature (364)..(364): n is a, c, g, or t
  modified_base (516)..(516): a, c, t, g, unknown or other
  misc_feature (516)..(516): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgcgcagcctctggattcaccttcagtagttatagcatgaactgggtccgccgaggcctccgaggggaaggggctggagtgggtctcatccattagtagtaatagtcgacctanagatactacgcagactcacgtagaacgggccgactccgaacctatccctaccaagacgaaccaaccgacccaaagaacctcactgtaactccgtagaacaaatgaaactagccgtagagacgaccggagacgacgggctaggtatattacgnggtagaccggagtaacggagtcttaatttacgaccgtaccggggaaacccctgttacgtttcg

SEQ ID NO: 344954 - DNA, 639 bp, Homo sapiens
  misc_feature: GZ8MTXP02HMOFK.11.27.C05.1.454.CMB.2.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (383)..(383): a, c, t, g, unknown or other
  misc_feature (383)..(383): n is a, c, g, or t
  modified_base (574)..(574): a, c, t, g, unknown or other
  misc_feature (574)..(574): n is a, c, g, or t
  modified_base (583)..(583): a, c, t, g, unknown or other
  misc_feature (583)..(583): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctctgcgnagcctntgattccaccttcagttagttaatagcagtagacgtcgggtccgccgaggcctccggaaggggaacggggctggggaggtgggtcctctactcctattaagtaagttaagtagtacgacctanagattactacgcagaccttcaacgtagggaacgggaccccacgtaccaacccgtatacccacccgaagaaccgtaaccaaaccgtaccaagtaaacccactactagttactaccgttagaaacctaaatcggaaacaccgtaccaggaacgaccgaccggtacggacgacggtcttagttacgtatttcgnggaacgggngtaacggagtataacgttacgttacgtaccggtaccgtaaccgttgttacgtttcg

SEQ ID NO: 344955 - DNA, 643 bp, Homo sapiens
  misc_feature: GZ8MTXP02I7Q0I.11.27.C05.1.454.CMB.2.raw
  modified_base (380)..(380): a, c, t, g, unknown or other
  misc_feature (380)..(380): n is a, c, g, or t
  modified_base (440)..(440): a, c, t, g, unknown or other
  misc_feature (440)..(440): n is a, c, g, or t
  modified_base (471)..(471): a, c, t, g, unknown or other
  misc_feature (471)..(471): n is a, c, g, or t
  modified_base (533)..(533): a, c, t, g, unknown or other
  misc_feature (533)..(533): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgcttattttagaaggtgtccagtgtgaggtgcagcgtggtggagtcgtgggggaggcctggtcaagccggtgggggtccctggagactctccgtgcgcgacgcctcgtgacttcacccttcagttagttatgcatagaactcggggtcccaccaggcctaccggaggggaagggcctggagtgggtctcgatccagtttagtagtaatgtcgtcctaangtaatactaccgcagactcacgtacggaacgggccgaactcaacctgtcctaccaagganaacccgtaacgaccaaagtaacctcaacgtntaactcgtacgaacctaaatcgaaacgacgccgtagaacgcggaaccgaggaccgtaacggngtttaggacgttaacttcgagggttacgacgggtaagacgggtaaacgtaacttaaacgtttaacgtacccgttaacccggggaaaaccccgttggttacgtttttacgg

SEQ ID NO: 344956 - DNA, 716 bp, Homo sapiens
  misc_feature: GZ8MTXP02JZM69.11.27.C05.1.454.CMB.2.raw
  modified_base (671)..(671): a, c, t, g, unknown or other
  misc_feature (671)..(671): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaacgtggggctccgcttgggttttccttgttgcttattttagaaggtgtccagtgtgaggtgcagcgtggtggaggtcggtgggggaggtccgtgggtacgaacggcccggttggggggtccctgacgactcctccgtcgcgcacgcctcgtgtacttctaccttcaagtagttatagctatacgaacggtcgggtcccgaccgagggaccgtaccgggaagggggaacggggtcggtagggtaggtgggtccgtacacttaccgtaagtttaaggttaagtaaataggttaccgacctaagaagtaacttacgtacgcacgtacctacgtaacgtagggaaccgggccctaactacccaacctacgttcccacgaaacggacgtaaaccgaacccacgaaaacgttacccaccttaacgtcgtaacttcctaaaggaacctaaaaggtcaaaccgacggtccgaggaaccggaggaaccccgggtaggaaccggtcgtcgtacgtttagtacgttacggtagtcggagacggtaagngttaactacgtttacgaccggtaaccgtaaccgtgttacgtttcg

SEQ ID NO: 344957 - DNA, 790 bp, Homo sapiens
  misc_feature: GZ8MTXP02HKJHJ.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcggtgggggaggcctggtcaagccgtggggggtccctgagactctcctgcgcagcctcgtggtacttcctaccttcagttagttatagcatagaacgtcgggtcccgccgacggcctaccggaggggaacggggcgtaggggacggttcggggtccttacgtacttacctaagtttaacgtaagttaaacgtacgtaccgtaccccttaagacgtaactaacgtaccgacacgtactacgaacgtacggggaaccgggggccccaaccgtacccaaacccgtacttacccgtacccgaaggaacccgtaaaacccgaaacccggaacccgaaaaacgtaacccgtaccaaacgtttagtaacttccgtaaaggaacccttaaaagtcggaaaaccacgggtaccctagggaacggtaccggaaccgggaacgggaccgaacggggtccgtttaggtacggttttaacgttaccgtagggttacgggaccgggtaaaggggtaacgggtacgttaacgtttaaaacgttttaccggtaaccggtttaaccccggaaaaccccggtttgtttaccgtttttaaccgg

SEQ ID NO: 344958 - DNA, 661 bp, Homo sapiens
  misc_feature: GZ8MTXP02F24FF.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcagccgtggggggtccctgagactctcctgcgcacgcctcgtgtacttccaccttcagttagttatagctatcgaacgtcgggtccgccgaggcctccgaaggggaaggggcgtgggaggtgggtctcactcctatttagtagtaatagtcgcctacagtactactacgacagactcacgtacgaacgggccactaccgaccagtccctaccaagacgtaccaaacccgaccaaaacggtaaaccctcgaaacttgttaaactaccgttacgaactaaaacgtaccgaaacgaacgtaccccgtagggaaacgacgggaccggaaacgaaccggtaaccggtcgttggttacggtttacttaacggtgtacgggtaccgaaggagtaacgtaagtttacttaacgtaccggtaccgtaacccgtagttcgttttaaccg

SEQ ID NO: 344959 - DNA, 732 bp, Homo sapiens
  misc_feature: GZ8MTXP02JVIAW.11.27.C05.1.454.CMB.2.raw
tcagcgagagataccacgaccggtgctcgatttagacgcgatcgaagggtttggaggagagaggagccttagccctggattccaaggcctatccacttggtgatcagcactgagcaccgaggattcaccatggaactgggctccgctgggttttccttgttgcttattttagaaggtgtccagtgtgaggtgcagcgtggtggagtcgtgggggagccgtggtcaaggccgtcgggggtccctgagtctctcctgcgcacgcctctggacttccaccttcagttagttatacgcagtagaacgtcggggtcccgccgacggccgtaccggaaggggacggggcgtggggacggtcgggtctcatacctagtttaagtaggtaatacggtcgacctataagtactaacgtacgacgtacgtaacctacgaacgtacggaaacggggtccccgtaaccgaccctaacccgtaacttcccgaaccgaaacggaaccaaaccgaaacccgaaacccgaaaacgtaacccgtactaacccttaggtaccttacgttaccgaaactaaaagtacgaaaccacgtacccgtagggaacgaccggaccggaacgggtaacccaacgggtccgttaaggttacgttaaccgttaacgtggtaccggacggtaaaggaacggtaaccggtaacttaactttaccggtaacggtttacccggaaaacccgttgttttacccgg

SEQ ID NO: 344960 - DNA, 581 bp, Homo sapiens
  misc_feature: GZ8MTXP02H2BSO.11.27.C05.1.454.CMB.2.raw
  modified_base (302)..(302): a, c, t, g, unknown or other
  misc_feature (302)..(302): n is a, c, g, or t
  modified_base (413)..(413): a, c, t, g, unknown or other
  misc_feature (413)..(413): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttcctgttgctattttagaaggtgtccagtgtgaggtgcagctgggtggagtcgtgggggagcctggtcaagccgtggggggtccctgagactctcctagcgcaggcctctggacttcacctttcagtagttatagcatgaactggtccncaggctcgagggagggctggaggtggtctagatccagttagtacgtaaatgtcgacctacgagactacgtacgcacgacttcacgtagaaccggggcctactcaacccgtnccacgaagacgaactaaacgacaaagtactctacgtatatacgtagaactaaagacgacgacgacgagacgacgacgacgacgacgtacgtacgtagtacgtacgtacgtacgtacgacggaggacgtaacgtacgtacgtacgtaccggtaccgtacgttacgttcg

SEQ ID NO: 344961 - DNA, 667 bp, Homo sapiens
  misc_feature: GZ8MTXP02JR3GO.11.27.C05.1.454.CMB.2.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (556)..(556): a, c, t, g, unknown or other
  misc_feature (556)..(556): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgcttggttttccttgttgcttattttagaagtgtccagtgtgaggtgcagctggtggagtcggtgggggaggccgtggtcaaggccggtgggggtccctgacgactctcctgcncagcctgtgcttcnccttcgagtagttatagctagtagtaacgtcggtcccgaccgacgggtcctacggggaaggggaaggggtcgtaaggggtggttcgggtacctacgtacttaacttagtttaaagttaagttaaagttacggtacccctacgtaacgtaaagtacttaaccggtacgacacgtaacctacgacgtacgggaaccgggaccctaccaccactactacccgacgaacgaacaaccgaacgaaccctaaacgtaacctctaacgtagttactacggactaacgaaanacaacgacgtacgagacgacggacggaacgacgcgtacgttagtcgttattcggaggtacgagaaggtagtataacgttatttaccgacgaccggttaactcgtagtttcg

SEQ ID NO: 344962 - DNA, 733 bp, Homo sapiens
  misc_feature: GZ8MTXP02FITHK.11.27.C05.1.454.CMB.2.raw
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaaggccgtggggggtccctgagactctcctgcgcagcctcgtggacttcaccttcgagttagttatancatcgaacgtcggggtccnccgaggcctaccgggaaggggtaaggggcgtaggggacggttggggtcctacacttacccgtaagtttaagtaaggttaaacgtacggttcccgacccttaacgaagtaacttaaccgtaccgactacggtacctactaccgtagggaaccgggtacccgactacccaacctactcccgtaccgaagaaacgaacccgaaaccgacccgtaaaacgaacccttactaccgtacggttaactccgtagtaaactaaacgtaccgaaaacgacgtacccgtaaggacggaaacggaccggaaacgggaccgtacggtcgtaggttacgttaacttaccggtaggttacgggacgaacgggtaggtaacgtaaccgtttaagttaccgtaccgttaccggaaaccccgttagttacggttttacg

SEQ ID NO: 344963 - DNA, 666 bp, Homo sapiens
  misc_feature: GZ8MTXP02FK6NM.11.27.C05.1.454.CMB.2.raw
  modified_base (312)..(312): a, c, t, g, unknown or other
  misc_feature (312)..(312): n is a, c, g, or t
  modified_base (534)..(534): a, c, t, g, unknown or other
  misc_feature (534)..(534): n is a, c, g, or t
  modified_base (607)..(607): a, c, t, g, unknown or other
  misc_feature (607)..(607): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaaggccgtggggggtccctgacgactctcctgcgcacgcctctggtattccaccttcagttagttatagctatgaacgtcgggtcccnccgaggcctccggaaggggacggggcgtagggtggtcgggtctcacgtcctaaagtttaagtaagttaaagttacgtcccgtaccctaagaacgtaactactaccgcacgtacctacaacgtgggaaaccgggccctactaccgaacctatccgtacccaaggacaaacccgaaccaccgtaaactaactacacgttgtactactagaaacaatcgaaaacnggtcccagacggacgacccgggaaggtaccgacgggtactaggttagttactacgtggtaccgacggtaaagngggtaactaacgttaagtttacctacgggtaacccgtaaccctggtttccgttttaacg

SEQ ID NO: 344964 - DNA, 685 bp, Homo sapiens
  misc_feature: GZ8MTXP02GRPGE.11.27.C05.1.454.CMB.2.raw
  modified_base (443)..(443): a, c, t, g, unknown or other
  misc_feature (443)..(443): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgcttattttagaaggtgtccagtgtgaggtgcagcgtggtggagtcggtgggggagccgtggacaaggccgtggggggtccctggagtactcctcctgccgctacgtccgtcgtaggtacttcctaccgttctaggttagttatagcctataggtaaccgttcgggtccgacccgaggccgtacggacggggaaggggcgtagggtagtcgggtcctacacttaccgtaagttaagtaagtaataggtcctaccagtaagtactaccgtcgacgacgtaccnctaacggtaggaaccgggtccctaactaccaaacccttattacccgtaccgaaacggaccgaaaacccgaacccgaacccgtaaaagtaaccccctataccgttagttacgtacctagttaacaaaacgacgaactcgggaccctaggaacgaccggaccgagttaccgagttcgtacgtagttatacgttagcgtagacgaggctaagtaacttgtaccgtacgtaaccctgtctttacgg

SEQ ID NO: 344965 - DNA, 799 bp, Homo sapiens
  misc_feature: GZ8MTXP02GAGXD.11.27.C05.1.454.CMB.2.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (338)..(338): a, c, t, g, unknown or other
  misc_feature (338)..(338): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcggtgggggaggcctggtcaaggccgtggggggtccctgagactctcctgcgcngcctctggacttcaccttcagtagttatancatgaacgtgggtcccgcgacggctaccgaggggaaggggtcgtggggngttcggggtctactacgttccgaagtttaagtaacgttaaacgtacggtcgtacccctaacaagtaactaaccgtaccggacacggtacccttacgaaccgtaacggggaaaccggggtccccgtaaacctcccgaaacccttaccgttaccctacccgaaggaaaccggaaacccgaaacccggtaccccaaaacgtaaaaccccgttacgaaaccgttcggtaaacttccgttaggaaaccttaaaacgtacgtaaaccggtaccgaccgttaagggaaaccgacggggaacccggaaacgggtaaccggtccgggaaaccgttcgggtttacggtttaacctttacgggtttacggtacgggttaacgggtaaccgggaagggtacccggttaacgtttaagtttaacggttaaacccgtacccggggtaaacccttaggggtttccgtttttaacgg

SEQ ID NO: 344966 - DNA, 597 bp, Homo sapiens
  misc_feature: GZ8MTXP02HEHXA.11.27.C05.1.454.CMB.2.raw
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (442)..(442): a, c, t, g, unknown or other
  misc_feature (442)..(442): n is a, c, g, or t
  modified_base (524)..(524): a, c, t, g, unknown or other
  misc_feature (524)..(524): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcggtgggggaggcctggtcaagccgtggggggtccctggagactctcctgcgcacgtcctcgtggtacttctaccttcgagttagttacagcaatgaactcggggtcccncgaggcctcgaggggaggctggagtggtcncatcctattagtagtaatgtcgacctacagactactacgnacgactcactaggaacgggccactaccaccatccacagacacaacgacaagaacncactgtatctagacaaaagtcgaacgacgaccgtaggacgacgaccggaacggaccgacggcgtttagacggttacttacgngtaacggacgaggtacgggactaaccttagttaacgtccggtaacggaaacccccgttgtttacggttttccg

SEQ ID NO: 344967 - DNA, 679 bp, Homo sapiens
  misc_feature: GZ8MTXP02G85QI.11.27.C05.1.454.CMB.2.raw
  modified_base (612)..(612): a, c, t, g, unknown or other
  misc_feature (612)..(612): n is a, c, g, or t
  modified_base (626)..(626): a, c, t, g, unknown or other
  misc_feature (626)..(626): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgcttattttagaaggtgtccagtgtgaggtgcagctggtggagtcgtgggggagcctggtcaagccggtgggggtccctgagactctcctgcgcagcctcgtgtacttcgaccttcagttagttatagctatacgaacgtcgggtcccgccgacgggccttaccccgggaaggggggaacggggtccgtagggggtagggttcggggtaccttacccgtaacgttaccccgttaaagttttaaacgggttaaaggttaaagtttacggtaccgtaacccgttaacgaaacgtacttaacccgtaacgctacggtacctacgaccgtagggaaccgggaccctacctccgaacctctacccacgagaacgacctaacgaccgaaactactacatacgtattaccagaactaagtacgaacgacgtccgaggacgagaccggagaccgacggnttagtagttatcgngtagcgaaagtcggtataaccttagaccgttagaccgtacctgttagtttccg

SEQ ID NO: 344968 - DNA, 634 bp, Homo sapiens
  misc_feature: GZ8MTXP02F6UM9.11.27.C05.1.454.CMB.2.raw
  modified_base (256)..(257): a, c, t, g, unknown or other
  misc_feature (256)..(257): n is a, c, g, or t
  modified_base (509)..(509): a, c, t, g, unknown or other
  misc_feature (509)..(509): n is a, c, g, or t
  modified_base (586)..(586): a, c, t, g, unknown or other
  misc_feature (586)..(586): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctgggtggagtcgtgggggaggcctggtcaagccgtcgggggtcctgagactctcctgcgcnncctctggacttccaccttcagtagttatagcatgaactcgggtccgccgaggcctacggaggggaggggcgtaggaggtgggtctcatcctaagtttagtaagttaaatagtacgtacctaacagtactactacgacacgtactacgacgtagggaacgggaccgtacctaccaaccacgttccaccgaagacgaaacccgaaacgaccaaacgtaactacatcgttatcctagaaactaaagtacgaaacncgaccgtagaaggaccgacgaaggacctacgggctttggaccgtttaattccgggtagtacggagtaacggaggtanaacgtttaacgttacgtaccggaacggtacccttagttcggttttacg

SEQ ID NO: 344969 - DNA, 846 bp, Homo sapiens
  misc_feature: GZ8MTXP02FGPM3.11.27.C05.1.454.CMB.2.raw
tcagcgagagataccacgaccggtgctcgatttagacgcgatcgaagggtttgggggagagaggagccttagccctggattccagggcctatccacttggtgatcagcactgagcaccgaggattcaccatggaactggggctccgctgggttttccttgttgcttattttagaaggtgtccagtgtgaggtgcagctggtggagtcggtgggggaggcctgggtcaaggtccggtcggggggttcctgacgacttcctcctcgcgacacgtcctgttggacttcctaccttcaaggttattatacgacgattacggaacgtcggggtcccgaccgacgggtacctcccgggaagggggtaacgggggtcgtaggggtacgggtttacggggttacctacgaacgttacccgttaaagttttaaacgggtaaacgtttaaaaacgttcggttaacccgtacccccgtttaaagaaacgggttaaaccttaaacggtacccggaacctaccggtaaaccttaccccgtaaacggttaacgggggaaacccggggtaccccgaaaccccgtttacccaaaacccgttactaaccccgttacccgaaagaaacggaaacccgaaaaccgaaccccgtaaaagaaacccctcgtaaacctagttaactacctacgaacgtaaaacgtaacggaacctacggtacccgagggaaacggacggaacccggaaagggaacccggtacggcttaacgggtacgttaaagttttccgaggttccgagggtaacgaacgggttactaagttacgtttaaccacggtacccggtaaaacccgtgtttacggtttacg

SEQ ID NO: 344970 - DNA, 657 bp, Homo sapiens
  misc_feature: GZ8MTXP02JM6IX.11.27.C05.1.454.CMB.2.raw
  modified_base (420)..(420): a, c, t, g, unknown or other
  misc_feature (420)..(420): n is a, c, g, or t
  modified_base (451)..(451): a, c, t, g, unknown or other
  misc_feature (451)..(451): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtccctgagactctctgcgcagcctcgtggacttctaccttcagttagttatagctatcgaacgtgggtccgccgaggctaccggaggggacggggctgggagtcgggtctcgactccatttagtagtaagtacgtcgacctacgagtatacgtacgcagtactcacgtagaaggccactcaccntcccgacagacgaccaacgacccaaagtacnctactgtaactcgtaacgactaaagtcaaaacgtcgaccgtaggaaggaccgaccggaaacggggaacctaaccggggtgttaacgggttagtttaaacgtttaccgggacgggttaccggtacggaacggtacggtaagtaaccgtttaaaagttacccggtaccgggtaaacccgggtaacccgtttacgtttacggttttacg

SEQ ID NO: 344971 - DNA, 798 bp, Homo sapiens
  misc_feature: GZ8MTXP02HVGDN.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagccgtggtcagccgtgggggtccctgacgactctcctgcgcacgcctcgtggtacttccaccttcagttagttatagctatcgaacgttcgggcccgaccgaggcctaccggaaggggaacggggcgtaggggaggtgggtcctacagtcctagttaagtagtaaagtcgtccgtacctagaagtactacctacggactacggtactacacggttacgggaaccggggggtcccaaccttacccgaaccctacttacccgaccgaaggaaccgaaaccaaacccggacccaaaacgtaccctaccaacgttcgttaacttaccgtagaacgttaaaacgtacggaaaccgtacgaccgtacggaacggaccgggaaaccggggtacgggaaaacccggaccccggggttcggtttacgggtttaaggtttttaaaaccgttacggtttttacgggggtacgggtaaccgggggtaaacggggtaaaccgggttaacgttaaaccgttttaaacggttaaacccggtttaaccccggtaaccccggggtttaaacccccgtttacgggtttttaccggttttacgg

SEQ ID NO: 344972 - DNA, 643 bp, Homo sapiens
  misc_feature: GZ8MTXP02JQFEP.11.27.C05.1.454.CMB.2.raw
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (373)..(373): a, c, t, g, unknown or other
  misc_feature (373)..(373): n is a, c, g, or t
  modified_base (542)..(542): a, c, t, g, unknown or other
  misc_feature (542)..(542): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtccctgagactctcctgccgcacgcctntggattccaccttcagttagttanagctatgaacgtgggccgaccgaggcctcgaaggggagggctgggagtggtctcatcctagttagtagtaaatagtcgtacctanagtactactaccgctacgacctcaacgtggaaaccggggcctaactcccgaacactcctacgacggacgaaacccgaacgtacccaaaacgtactaccgaccgttagttaccttcgacggaactaaacgtacgaccaacgctaacgagggacgtaccggacggtaaccncggattcgtagttaacttcggttagacggtacgaaggtaaccggtattaaccgttaagttaccgtacggtacccggtaaccccgttagtacgttttaccgg

SEQ ID NO: 344973 - DNA, 770 bp, Homo sapiens
  misc_feature: GZ8MTXP02HC3SR.11.27.C05.1.454.CMB.2.raw
  modified_base (288)..(288): a, c, t, g, unknown or other
  misc_feature (288)..(288): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggtttccttgttgctattttagaaggtgtccagtgtgaggtgcagctggtggaggtcgtgggggaggccgtggtcaacggccgtggggggtcccctggagacgttcctccgtgacgcagcctcgtggtacttcaccttnagttagtatcgcagtgaactcgggtccgcctagggccttccggaaggggaggggcgtaggggtaggtcgggttcacgactaccgtaagttagtagtaaactagtccgaccttacgagtactaccgtaacgacgacgtacctacggtaaccgtagggaaaccggggccgtaacctacccgtaaacccgtaaactccccgtaaccgaaacgggaaacaacccgaaaaccggacccccttaaaaagtacccttaaactaccgtaacgttaccgttacgtaacggaacttaaaagaactaaaccgtacctaaccggtaacggacgaaccgggcccggttaaaggaccgaacgggttaccgtggtttaaaacgtacgtttaccggtaacggtacgggtaacgggtaacggaacgggttacgtaaacttttaaacgtaccggttaaccggttacccggtaaaccccgtttaggtttaaccggttttcg

SEQ ID NO: 344974 - DNA, 646 bp, Homo sapiens
  misc_feature: GZ8MTXP02GUXZZ.11.27.C05.1.454.CMB.2.raw
tcagcgagagataccacgaccggtgctcgatttagacgcgatcgaagggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgcgcagcctctggattcaccttcagttagttatagcatagaacgtcgggtccgccgaggcctccgaggggaaggggcgtgggaggtgggtctcatcctagttagtaagtaaattagtcgaccttaacagtaactacctacgaccacgacctacgtaacgtacggaacggggtacccgactacccgaacccattcccaccgaaaggaccgaaacccaaacggcccaaaagtaacctcaccgttagtaatccctaagaacctaaaagtagaaaccgagtccgtaaggacgacgacccggaggaaccgacgggtcttagtagttaacttacgtggtacgacggaggaggagtaacttaacgttacgtaccggtaccggaacccgtagttgtttaccg

SEQ ID NO: 344975 - DNA, 555 bp, Homo sapiens
  misc_feature: GZ8MTXP02G1E1Y.11.27.C05.1.454.CMB.2.raw
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
  modified_base (496)..(496): a, c, t, g, unknown or other
  misc_feature (496)..(496): n is a, c, g, or t
tcagcgagagataccacgaccggtgctcgatttagacgcgatcgaaggggtttgggggagagaggagccttagccctggattccaaggcctatccacttggtgatcagcactgagcaccgaggattcaccatggaactggggctccgctggttttcctgttgctattttagaaggtgtccagtgtgaggtgcagctggtggagtcgtgggggagccgtggtcaagccgtggggggtccctgagactctcctgcgcagcctctggattcaccttcagtagttanagcatgaacgtggtccnccagctcgaggggaaggctggagtgggtctacgctacagttagtaagtaatagtcgacctanagatactacgacngactacacgtcgaagggcccactacacccaatcccgacaaggacaaccaaccgtccaaagaacctcacgtntaactctagacaaaagtcaacacgtccgagagacgacggagtacgacgtntcgtagtatcgtgtacgacgaggagtatcttacgtacgtacgtacgacctgttacgtcg

SEQ ID NO: 344976 - DNA, 768 bp, Homo sapiens
  misc_feature: GZ8MTXP02I3ALJ.11.27.C05.1.454.CMB.2.raw
  modified_base (395)..(395): a, c, t, g, unknown or other
  misc_feature (395)..(395): n is a, c, g, or t
  modified_base (491)..(491): a, c, t, g, unknown or other
  misc_feature (491)..(491): n is a, c, g, or t
tcagcgagagataccacgaccggtgctcgatttagacgcgatcgaagggtttgggggagagaggagccttagccctggattccaaggcctatccacttggtgatcagcactgagcaccgaggattcaccatggaactggggctccgcttgggttttccttgttgcttattttagaaggtgtccagtgtgaggtgcagcgtgggtggagtcggtgggggacggtccgtggtcgaacggccggttggggggtccctgagtacctctcctgcgcacgtcctcgtcggtacttccgtaccctttacaaggttaagttaatacggctaacgtacgtaaaccggtcgggtccccggcccgtagggtcccgtaccgggaagggggaacggggcgttaggggnggttcggggtctactacgtactaagtttaaggtaagtaagtagccgtacctacagtaactactacgcacgtctcacgtaggacggcgactccgacncgttcccaacgaggactaaacccacgacccctaaaagaccctacaacgttcgtaaattccgaacgtaacctaaatacgggaaaacccaggacccgtaggaacgggaaccggaccgggaaagttaaccggtaccggtgttaagtttacgttacgttaccgggttaggaccggaacgggttaacggggaacgtttaagggtaaccgtttaaactttttaacccggaacccggggtttacccgggtaaaaaccccgggtttgttttaaccggtttttcgg

SEQ ID NO: 344977 - DNA, 488 bp, Homo sapiens
  misc_feature: GZ8MTXP01ENKZF.15.8.A08.1.454.CMB.2.raw
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccgnagtctgaagtntttgctagtttatactgtcagcaatataacagtgactattcactttcggccagggaccaaagtgatatacaaacgactgtggctgcaccatctgttcttcatccttcccgccatcttgaacgctaacg

SEQ ID NO: 344978 - DNA, 490 bp, Homo sapiens
  misc_feature: GZ8MTXP01DQHJG.15.8.A08.1.454.CMB.2.raw
  modified_base (352)..(352): a, c, t, g, unknown or other
  misc_feature (352)..(352): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatccccagccaggttcagtggcagtgggtctggcacagagttccactctcaccatcagcagccccgnagtctgaagtatttgctagtttatactgtcagcaatataacaagtgacattcactttcggccagggaccaaagtgatatacaaacgaactgtggctgcaccatctgttcttcatcttcccnctntcttgtcgcgtaag

SEQ ID NO: 344979 - DNA, 527 bp, Homo sapiens
  misc_feature: GZ8MTXP01DM2QB.15.8.A08.1.454.CMB.2.raw
  modified_base (168)..(168): a, c, t, g, unknown or other
  misc_feature (168)..(168): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (399)..(399): a, c, t, g, unknown or other
  misc_feature (399)..(399): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatccccagccaggttcaggtggcaggtgggtctggcacagacgttccactctcacccatccagcagccccgnagtctagaagttntttgntagttatactgtcagactaatanaacagtcgactattcgtacgttcggaccgacggaacaagtgaatatacgtaaacgtacgtgtggctcgactacagttctcgttcttcttacgttcccttcccgctactcgttagtaacgttcgtaacg

SEQ ID NO: 344980 - DNA, 574 bp, Homo sapiens
  misc_feature: GZ8MTXP01CM4UQ.15.8.A08.1.454.CMB.2.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
tcagtctacgtagccacgaccggtgctcgatttagcatactctacagggtggctggagactgcgtcgatcgactaacgttctcttcctcctgctactctggctcccagataccactggagaagtagtgatgacgcagtctccagccaccctgtctgtgtcgtccgggggaaagacgccaccctctcctgcagggccagtcagagagttgccgccagtttagcctaggtaccaacagaaacctggccacgcctcccaggcctcctcatctatgctgcatccagttagggacactggtatccccagccaggttcagtggcaggtgggtctggcacgagtattccactctcaccntacagcagccctnagtcagaaagttntttgattagtttatactgtactanactaataataacgtaagtacgtactacttacgttacgttaccggtaccgaacggaacgtaaacggtagtaagtaactaacgtaaacgtaacgtacgtcggtcgtcgactacttacgtcgttcttcttcttacttccttcccgtcctactcgttacgtaacgttaacgtaacg

SEQ ID NO: 344981 - DNA, 672 bp, Homo sapiens
  misc_feature: GZ8MTXP01CVF3B.15.8.A08.1.454.CMB.2.raw
  modified_base (170)..(170): a, c, t, g, unknown or other
  misc_feature (170)..(170): n is a, c, g, or t
  modified_base (400)..(400): a, c, t, g, unknown or other
  misc_feature (400)..(400): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgcccaccctctcctgcgagggccagtcagagagttcgccgctagtttacgcctaggtaaccaacagaaacctggccacgccctcccgaggcctcctcatctatgctgacataccagttacggacacgtggtaactcccagccaggttcaggtggctaggtggctggcacgagtacgttcccactctcaccatcgaagccgacgccccgatacggtctagggaaatttntttacgtacttagtttacttacgtgtacaagtaactaaataactaaacgtaacggtacgtaccttaactttaccggttaacccggtttacccgggaacccgtaaacgggtaaaccgtaaaggtacgtaaacttaaacgtaaaccgtaaaaccgtacgttcggtacggaacgttacgaccctaacttacgttcgttacgtttaccttaccttaccctttccccgttaccccgtaaccttacgttaccgttacggtaaccgttaaccgttaacg

SEQ ID NO: 344982 - DNA, 518 bp, Homo sapiens
  misc_feature: GZ8MTXP01EVZNN.15.8.A08.1.454.CMB.2.raw
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatccccagccaggttcagtggcagttgggtctggcacgagngttccactctcaccatcagcagcccgnagtctgaagtntttgctagtttatactgtcagactaaatataaacgaagtgacctattcgtacgtttccggacccgacgggaaccaaagtggatatacaaacgtaactgtggctgcaccatctgttcttcacttccttccccgctatccttagcgttcgtaacg

SEQ ID NO: 344983 - DNA, 521 bp, Homo sapiens
  misc_feature: GZ8MTXP01C3M1A.15.8.A08.1.454.CMB.2.raw
  modified_base (168)..(168): a, c, t, g, unknown or other
  misc_feature (168)..(168): n is a, c, g, or t
  modified_base (351)..(351): a, c, t, g, unknown or other
  misc_feature (351)..(351): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcaggtggtctggcacagagttccactctcaccatcagcagcccgnagtctagaagtattttgctagtttattactgtacagcaaatataacaagtggacctattcacgtttccggacccaaggggaacccaaaggtcggaataatacaaacgactgtggctgcaccattctgttcttcacttccttacccgcctagtcttagtaacgcgttaacg

SEQ ID NO: 344984 - DNA, 500 bp, Homo sapiens
  misc_feature: GZ8MTXP01CFHX0.15.8.A08.1.454.CMB.2.raw
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggatccccagccaggttcagtggcaggtgggtctggcacgagagttcccactctcaccatcagcagcccgnagtctgaagtntttgctagtttattactgtcagactaatataacagtggctattcactttcggcccagggaccaaagtgatatacaaagactgtggctgcaccatctgttcttcacttccttcccgcatcttcgtaagttcgtaacg

SEQ ID NO: 344985 - DNA, 563 bp, Homo sapiens
  misc_feature: GZ8MTXP01DRIXD.15.8.A08.1.454.CMB.2.raw
  modified_base (303)..(303): a, c, t, g, unknown or other
  misc_feature (303)..(303): n is a, c, g, or t
  modified_base (498)..(498): a, c, t, g, unknown or other
  misc_feature (498)..(498): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattaggacatggtatccagcaggttcagtggnagtggtctggcacagagttccactctcaccatcagcacgcccgtcagtctgtagtattttagctagttattactgtctagactataataacaaagtggtacctacttactaccgttttccggaccccgaacggggaaccaaacgggtaggtaataagtacaaaccgtaaccttaggcggtcgttcgcgaaccccngttaccctgtttcccttcttaccctcttttacccccgccctcgtacttgtaacgttaacgtaacg

SEQ ID NO: 344986 - DNA, 491 bp, Homo sapiens
  misc_feature: GZ8MTXP01DEWRE.15.8.A08.1.454.CMB.2.raw
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
  modified_base (476)..(476): a, c, t, g, unknown or other
  misc_feature (476)..(476): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctccaggctcctcatctatgctgcatccattagggacactggatccccagccaggttcagtgcagtggtctggcacngagttccactctcaccatccagcagcccgnagtctgaagtatttgctagtttatactgtacagcaatataacaagtggacctattcacgtttcggacccagggaccaaagtggatatcaaacgactgtgctgcacatctgttcttcatcttcccgcntcttgaacgctaacg

SEQ ID NO: 344987 - DNA, 561 bp, Homo sapiens
  misc_feature: GZ8MTXP01CVMZ4.15.8.A08.1.454.CMB.2.raw
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctatgctgcatccattagggacactggtactcccagccaggttcagtggcaggtggctggcacagagttccactctcaccatcagcacgcccgnagtctagaagtntttgctagtttattactgtacagactaatataacaagtcgacctattctacgtttccggacccaggggaaccaaagtcggaataacgtacaaaacgtaactggtcggctcgacctacccagttcctcgttcctttccttacctttcccgtttacccccgtcctacgttccgttacggtaaccgttaaccgttaacg

SEQ ID NO: 344988 - DNA, 498 bp, Homo sapiens
  misc_feature: GZ8MTXP01EWSN5.15.8.A08.1.454.CMB.2.raw
  modified_base (168)..(168): a, c, t, g, unknown or other
  misc_feature (168)..(168): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (448)..(448): a, c, t, g, unknown or other
  misc_feature (448)..(448): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggcctcctcatctatgctgcatccattagggacactggtatccccagccaggttcagtggcagtgggtctggcacagagttccactcncaccatcagcagcccgnagtctagaagtatttgctagtttatactgtcagcaatataacagtgacctattcactttcggccagggaccaaagtgatatacaaacgaactgnggctgcaccatctgttcttcatccttcccgccatcttgaacgttctaacg

SEQ ID NO: 344989 - DNA, 524 bp, Homo sapiens
  misc_feature: GZ8MTXP01DJI14.15.8.A08.1.454.CMB.2.raw
  modified_base (355)..(355): a, c, t, g, unknown or other
  misc_feature (355)..(355): n is a, c, g, or t
  modified_base (508)..(508): a, c, t, g, unknown or other
  misc_feature (508)..(508): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatccccagccaggttcagtggcaggtgggtctggcacagagttcccactctcaccatcagcagccccgnagtctagaagtatttgctagtttattactgtcagactaaataataaacaagtggacctattacgtactttccgggacccgtaacgggaacccgaaagtaggataactacaaacgtaacgtgtggctgcaccatctgttcttcacttcctcccnccatcttgtgctaacg

SEQ ID NO: 344990 - DNA, 578 bp, Homo sapiens
  misc_feature: GZ8MTXP01BNTT3.15.8.A08.1.454.CMB.2.raw
  modified_base (168)..(168): a, c, t, g, unknown or other
  misc_feature (168)..(168): n is a, c, g, or t
  modified_base (229)..(229): a, c, t, g, unknown or other
  misc_feature (229)..(229): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctaggtaccaanagaaacctggccagccctcccgaggcctcctcatctatgctgcatccagttaggacactggtactcccagccaggttcagtggcaggtggtctggcacgagacgttccactctcaccatacagcacgcccgatagtctaggaattatttgcttagtttatacgtgtcagactaatataacaagtcgacctacgttactacgtttccggacccgaacgggtaacctaaaggtacggaataactaacgaaacgtaacgtggtcggtctcgacctaccttacgttccttacgttcctttcttacctttcccttaccccgtccttactcgttacgtaacgttccgttaaccgg

SEQ ID NO: 344991 - DNA, 501 bp, Homo sapiens
  misc_feature: GZ8MTXP01C39A1.15.8.A08.1.454.CMB.2.raw
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggatccccagccaggttcagtggcaggtgggctggcacagagttccactctcaccatcagcagccccgnagtctgaagtatttgctagtttattactgtacagacaatataacaagtgacctattctactttcggaccctagggaccaaagtggataactacaaacgactgtggctgcacatctgttcttcatccttccgccatcttgtcgcgtaacg

SEQ ID NO: 344992 - DNA, 531 bp, Homo sapiens
  misc_feature: GZ8MTXP01APOA1.15.8.A08.1.454.CMB.2.raw
  modified_base (168)..(168): a, c, t, g, unknown or other
  misc_feature (168)..(168): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccattagggacactggtactcccagccaggttcagtggcagtgggtctggcacgagagtttcccactctacacccatcagcacgcccgnagtctagaagtatttgctagtttatactgtacagacaatanaacaagtggacctattcgtacgtttcgggacccaacgggaacctaaaggtgataagtctaaacgactgtggctgacaccagttcctgttcttcacttcccttcccgcctatccttagtaacgttcgttaacgg

SEQ ID NO: 344993 - DNA, 553 bp, Homo sapiens
  misc_feature: GZ8MTXP01A3L8Z.15.8.A08.1.454.CMB.2.raw
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctaggtaccaacagaaacctggccagcctccaggctccttatctatgctgcatccattagggacactggtatcccagccaggttcaggtggcaggtgggtctggcacagtacgttcacctctacaccatcgaagcncgccccgtnacgtctagagttntttcgattatttatactgtananataataataacagtacgtactacttactaccggttacgtaccgtaacggaacgaagtagtagtaactaacaaacgtaacgtagtcgcgtcgcactacttcgtcgttcttcttcttcctccctcctaactcgtcgttacgtaacgttaacgtaacg

SEQ ID NO: 344994 - DNA, 507 bp, Homo sapiens
  misc_feature: GZ8MTXP01BA7LZ.15.8.A08.1.454.CMB.2.raw
  modified_base (169)..(169): a, c, t, g, unknown or other
  misc_feature (169)..(169): n is a, c, g, or t
  modified_base (351)..(351): a, c, t, g, unknown or other
  misc_feature (351)..(351): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttagcctggtaccaacagaaacctggccagcctccaggctctcatctatgctgcatccattaggacactggtactcccagccaggttcagtggcaggtggtctggcacagagttccactctcaccatcagcagccccgnagtctagaagtatttgctagtttatactgtcagacaatataacaagtggacctattctactttcggacccagggaaccaaagtggatatacaaacgtaactgtggctgcaccatctgttcttcactccttccccgctactcttagtcgttcgtaag

SEQ ID NO: 344995 - DNA, 534 bp, Homo sapiens
  misc_feature: GZ8MTXP01ETN6T.15.8.A08.1.454.CMB.2.raw
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgctagtttagcctggtaaccaacagaaacctggccagccctccaggctcctcatctatgctgcatccagttagggacactggtactccccagccaggttcagtggcaggtgggtctggcacgagacgttcccactctacaccatccagccagccccgnagtctagaatatttgctagtttattactgtcagactaaatataaacagtcgacctattcgtactttccggacccgaacgggaaccaaaggtgaataatacgaaacgtaactgtggctcgcaccttatctgttcttcttacttccttcccgccatccttgtaacgctaacg

SEQ ID NO: 344996 - DNA, 494 bp, Homo sapiens
  misc_feature: GZ8MTXP01AQ246.15.8.A08.1.454.CMB.2.raw
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatccccagccaggttcagtggcagtgggtctggcacagagttccactctcaccatcagcagcccgnagtctgaagtntttgctagtttatactgtcagcaatataacagtgctattcgacttcggccaggaccaagtgatatacaaacgactggtggctgcaccatctgttcttcacttccttcccgcctagtcttgtaacgcgtaacg

SEQ ID NO: 344997 - DNA, 556 bp, Homo sapiens
  misc_feature: GZ8MTXP01BMN6Q.15.8.A08.1.454.CMB.2.raw
  modified_base (169)..(169): a, c, t, g, unknown or other
  misc_feature (169)..(169): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttacgcctggtaccaacagaaacctggccagcctccaggctcctcatctatgctgcatccaagttagggactacgtggtactccccgagcctaggttcaggtggctagggtgggtctggacctacgagtacgtttccccacttctacaaccataccacgccacgccccgaaancgtctaggaaagttntttcgtacttagtttacttactgtacagactaaataataacgaagtcgactattctacgtttcggaccaaggaccaaagtgatactacgaaacgtactgtggctgcacttagtctcttcttcacttcctccctcactcttcgaacgttcgtaacg

SEQ ID NO: 344998 - DNA, 517 bp, Homo sapiens
  misc_feature: GZ8MTXP01DOQF5.15.8.A08.1.454.CMB.2.raw
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagccctcccaggctcctcatctatgctgcatccattagggacatggtactcccagccaggttcagtggcaggtgggctggcacagacgttccactctcacccatccagcagcccgnagtctagaagtntttgctagtttattactgtacagactaatataacaagtcggacctattctactttcggacccagggaccaaagtggataagtcaaacgacgtgtggctcgcaccagtctgttacttcactccttccccnctntcttgtaacgttcgtaacg

SEQ ID NO: 344999 - DNA, 520 bp, Homo sapiens
  misc_feature: GZ8MTXP01CTBRO.15.8.A08.1.454.CMB.2.raw
  modified_base (170)..(170): a, c, t, g, unknown or other
  misc_feature (170)..(170): n is a, c, g, or t
  modified_base (259)..(259): a, c, t, g, unknown or other
  misc_feature (259)..(259): n is a, c, g, or t
  modified_base (362)..(362): a, c, t, g, unknown or other
  misc_feature (362)..(362): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanagcccaccctctcctgcagggccagtcagagagttgccgctagtttagcctaggtaccaacagaaacctggccagcctcccaggctccncatctatgctgcatccagttagggactactggtatccccagccaggttcagtggcaggtggctggcacgagacgttccactctcaccgatcaagcagtcccgnagtctagaaagtatttgactagtttatactgtacagtacaatataaacagtgacctaatcgtactttcggaccagggacaaagtgaatagtacaaacgatgtgctgcctacatcgnttcttcacgtccttccccnctntcgttacgtaacgcgtaacg

SEQ ID NO: 345000 - DNA, 603 bp, Homo sapiens
  misc_feature: GZ8MTXP01DTFYN.15.8.A08.1.454.CMB.2.raw
  modified_base (256)..(256): a, c, t, g, unknown or other
  misc_feature (256)..(256): n is a, c, g, or t
  modified_base (394)..(394): a, c, t, g, unknown or other
  misc_feature (394)..(394): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagcctccaggctcctnatctatgctgcatccagttagggacacgtggtactccccgagccaggttcaggtggctaggtgggtctggcacagtagtttccatttctaccaccataccgaagccgacgccccgacgtacgtccgtaggaaacgttnttttggacttaaggtttacttacttgttacaagtactaaattaactaaacgaaagttcggacctactttacgtaccgttttaccgggacccgtaaaggggaacccaaaggtcggaataactaacgaaaacgtacgtaggtggtctgcctaccttagtccttcgttcttcttacttccctcccgcctactcttacgtaacgttcgtaacg

SEQ ID NO: 345001 - DNA, 522 bp, Homo sapiens
  misc_feature: GZ8MTXP01C9WHE.15.8.A08.1.454.CMB.2.raw
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (402)..(402): a, c, t, g, unknown or other
  misc_feature (402)..(402): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctatgctgcatccagttagggacactggtactcccagccaggttcagtggcaggttggctggcacgngtacgttccactctcaccatcagcacgcccgnagtctagtaagtatttgactagtttatactgtacagtacaatanaacagtcgactattcgtacgttcggacctagggaccaagtgataactacaaacgtactgtggctcgctaccagttctgttcttcacttcccttacccgctatcttagtaacgcgttaacg

SEQ ID NO: 345002 - DNA, 696 bp, Homo sapiens
  misc_feature: GZ8MTXP01CA0QO.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagccctcccaggcctcctcatctatgctgcatccagttagggacactggtactcccgagccaggttcagtggctaggtgggtctggcacgagtacgtttcccacttctacaccctagtccaacgccgacgcccccgtagtacgtccgtaggtaaacgttagttttacgtacttaaggttttaatttaccgttgttaccgaacgtacctaaagttaaactaaacgtaacgttacggtaacccttactttaccggtaaccgtttttacccggggaccccggttaacggggaaaccccgtaaaggttacggtaaattaacgtaaccgtaaaaccggtaacgttacggtacgggtaaccgttcggaccgtaacccttagttaccttcgttaccgtttccttaccgtttccccttaccccggtaacccttacttcgttacgaaccgttcgttaaacccggg

SEQ ID NO: 345003 - DNA, 571 bp, Homo sapiens
  misc_feature: GZ8MTXP01ALMGJ.15.8.A08.1.454.CMB.2.raw
  modified_base (169)..(169): a, c, t, g, unknown or other
  misc_feature (169)..(169): n is a, c, g, or t
  modified_base (545)..(545): a, c, t, g, unknown or other
  misc_feature (545)..(545): n is a, c, g, or t
  modified_base (554)..(554): a, c, t, g, unknown or other
  misc_feature (554)..(554): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttagcctggtaccaacagaaacctggccagcctccaggctcctcatctatgctgcatccaagttagggacacgtggtactctcagcctaggttcaggttcggcgtagggttcggggtactgggacctacgaggtaccgttcacttcctaccaccaatccaaggccaacggccccgcagtctagtaacgtatttagcttagtttatacttgtacagtactaatataactaagtcgtacctacttctacgtttccggacccgtaacggggaaccaaaggtagaagtactaacaaacgtacgtggtcggcttcgcacgtatcgttcgttcttacncttctcccncattcgtcgcgtaaccg

SEQ ID NO: 345004 - DNA, 523 bp, Homo sapiens
  misc_feature: GZ8MTXP01D0CKC.15.8.A08.1.454.CMB.2.raw
  modified_base (169)..(169): a, c, t, g, unknown or other
  misc_feature (169)..(169): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (464)..(464): a, c, t, g, unknown or other
  misc_feature (464)..(464): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagcccaccctctcctgcagggccagtcagagagttgccgctagtttagcctggtaaccaacagaaacctggccagcctccaggctcctcatctatgctgcatccagttagggacactggtactcccagccaggttcagtggcaggtgggtctggcacagacgttccactctcaccatcagcacgcccgnagtctagaaagtttnttnatattatactntacanactaatactaacgagtcgactacttcgtacgttccggaccgacggaacaagtagatacactaacgtacgtgngctcgcacttatcgtcttcttcacttcctcccgctactcgttacgtaacgttcgtaacg

SEQ ID NO: 345005 - DNA, 547 bp, Homo sapiens
  misc_feature: GZ8MTXP01EIS12.15.8.A08.1.454.CMB.2.raw
  modified_base (168)..(168): a, c, t, g, unknown or other
  misc_feature (168)..(168): n is a, c, g, or t
  modified_base (374)..(374): a, c, t, g, unknown or other
  misc_feature (374)..(374): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgcctagtttagcctggtaccaacagaaacctggccagcctcccaggctcctcatctatgctgcatccagttacgggactacgtggtactccccagcctaggtttcaggttcggctagggttgggtctggcctaacagtacgttcccactctacaccatcagcacgcccgnagtctagaagttactttgcttagtttattctgtacagactaaatataacaagtcgactattctacgttccggaccgaggaaccaagtgatactacgaaacgtactgtgctcgctacttagttctcttcttccttacttcccttacccgctactcttacgtaacgttcgtaacg

SEQ ID NO: 345006 - DNA, 514 bp, Homo sapiens
  misc_feature: GZ8MTXP01EFXWA.15.8.A08.1.454.CMB.2.raw
  modified_base (168)..(168): a, c, t, g, unknown or other
  misc_feature (168)..(168): n is a, c, g, or t
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaanagaaacctggccagcctcccaggctcctcatcatgctgcatccattagggacactggtatccccagccagttcagtggcagtggtctggcanagattcccactctcaccntcagcacgcccgnagtctagaagttntttgctagtttattactgtctagactaataataacaagtgactattctacgtttcggaccagggaccaaagtggaatatacaaacgaactgtggctcgcaccttagtctgttcttcacttccttcccgcctatcttgtaacgttctaacgg

SEQ ID NO: 345007 - DNA, 534 bp, Homo sapiens
  misc_feature: GZ8MTXP01CJWVR.15.8.A08.1.454.CMB.2.raw
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (493)..(493): a, c, t, g, unknown or other
  misc_feature (493)..(493): n is a, c, g, or t
  modified_base (513)..(513): a, c, t, g, unknown or other
  misc_feature (513)..(513): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtactcccagccaggttcagtggcaggtgggtctggcacgngagttccactctcaccatcagcagccccgnagtcagtaattntttgacttagtttattactgtacagactaataactaaacgagtcgactacttaccgtacgtttccggaccgaacgggaacaaggtgaatacgaacgtaaacgtacgtgtgctgactacttgttctnttcttcacttcctcccgctntcgttagtaacgttcgtaacg

SEQ ID NO: 345008 - DNA, 552 bp, Homo sapiens
  misc_feature: GZ8MTXP01D4BZJ.15.8.A08.1.454.CMB.2.raw
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaanagaaacctggccagcctccaggctctcatctatgctgcatccattaggacatggtatcccagccaggttcagtgcaggtggtctggccangtagttttaccccnctacacatcaacgcncgcccagtagtctagtaagttatttcgattatttatctgtacagtactaataataacgagtcgactattcgtacggttccggaccgtacggaactaaggtgaattacgtaacgaaacgtacgtgtcggctaacgacttactcttcgtagttcttcttccttcccgttcccgtcctaacgtcgtacgttacgtaacgttaacgtaacg

SEQ ID NO: 345009 - DNA, 715 bp, Homo sapiens
  misc_feature: GZ8MTXP01BXTH4.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctaggtaccaacagaaacctggccagcctctaggctcctcatctatgctgcatccagttaggacactggtactcccagccaggttcagtggcaggtgggtctggcacgagtacgtttcccacttcacaaccataccaacggccaacggccccccgagtacggttacctagggtaaaaggttattttttcggaccttaaaggtttttaacttaccgttggttaccaaaggtacctaaaattaactaaaccgtaaaggttcggacctaacttttaccggaacccgtttttccggggaacccccgttaaagggggaaaccctaaaagggttcggtaaattaaacttaacccgaaaaacggtaaaccgttgggtaacgggtccttaacggaccctaaacccgttaattaccggtttacgtttaccccgtttcttaaccgttttcccctttacccccggaaccttaactcccgttacggtaacgttaacccgtttaaaccggg

SEQ ID NO: 345010 - DNA, 596 bp, Homo sapiens
  misc_feature: GZ8MTXP01DY2U0.15.8.A08.1.454.CMB.2.raw
  modified_base (168)..(168): a, c, t, g, unknown or other
  misc_feature (168)..(168): n is a, c, g, or t
  modified_base (427)..(427): a, c, t, g, unknown or other
  misc_feature (427)..(427): n is a, c, g, or t
  modified_base (558)..(558): a, c, t, g, unknown or other
  misc_feature (558)..(558): n is a, c, g, or t
  modified_base (574)..(574): a, c, t, g, unknown or other
  misc_feature (574)..(574): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttcgccgcctagttttacgcctggtaaccaacagaaacctggcccagccctcccaggcctcctcatctatgctgcactccaagttacgggacctacgtggtaactcccccgaggccctaaggggtttccaaggttgggcctagggtttcggggtcctgggccaacgaggtacgtttccccaacttctacacccataccagccacgcccccgatagtctagaacgttntttgacttagtttattactgtactagactaataactaacgaagtcgactactttcgtaccgtttccggaccgtaagggaacctaaaggtgaataactacgtaaacgtacgtgtggctgacaccttagtctnttcttcactcctcccnctactcttagtcgttcgtaacg

SEQ ID NO: 345011 - DNA, 542 bp, Homo sapiens
  misc_feature: GZ8MTXP01C2UV9.15.8.A08.1.454.CMB.2.raw
  modified_base (169)..(169): a, c, t, g, unknown or other
  misc_feature (169)..(169): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttagcctggtaccaacagaaacctggccagcctcccaggcctcctcatctatgctgcatccagttagggacactggtactcccagccaggttcagtggcagtgggctggcacagacgttcccactctcacccatccagccagtccccgnagtctagaaagttnttgattagttatactgtacagtactaataactaagagtcgtactattcgtacgttccggaccgaacggaactaagtgatactacgtaaacgtagtcgtgctcgactacttgtctcgttccttcttaccgtttccccactcgtctacgttacgtaacgttaacgtaag

SEQ ID NO: 345012 - DNA, 522 bp, Homo sapiens
  misc_feature: GZ8MTXP01DVPAG.15.8.A08.1.454.CMB.2.raw
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaanagaaacctggccagcctcccaggctcctcatctatgctgcatccagttagggacactggtatccccagccaggttcagtggcaggtgggctggcanagagttccactctcaccatcagcacgcccgcagtctgaaagtatttgctagtttattactgtacagacaaatataacaagtcggtaccaatttcgactttccggacccaagggaccaaagtggataatacaaaacgactagtggctgcaccttatctcgttcttcacttccttacccgcctaatccttagcgcttaacg

SEQ ID NO: 345013 - DNA, 552 bp, Homo sapiens
  misc_feature: GZ8MTXP01B52ZP.15.8.A08.1.454.CMB.2.raw
  modified_base (169)..(169): a, c, t, g, unknown or other
  misc_feature (169)..(169): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttagcctggtaccaacagaaacctggccagcctccaggctcctcatctatgctagaactccattagggacacgtggtactccccgagccctaggttcaggtggctaggtgggtctgggcacgagagttccacctctacaccatcaagccaacgcccgnacggtctaggaacgttnttttgacttagtttatactgtacagtactaaatataaacgagtcgacctattcctacggtttcggaccgaaggaaccaaaggtgaatactacaaacgtactgtcgctcgacactattctagttcttcgcttccttcccgctaatcctgacgtcgttaacgtaacg

SEQ ID NO: 345014 - DNA, 490 bp, Homo sapiens
  misc_feature: GZ8MTXP01DN8WQ.15.8.A08.1.454.CMB.2.raw
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (384)..(384): a, c, t, g, unknown or other
  misc_feature (384)..(384): n is a, c, g, or t
  modified_base (464)..(464): a, c, t, g, unknown or other
  misc_feature (464)..(464): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgcaagtttagcctggtaccaacagaaacctggccagcctccaggctcctcatctatgctgcatccattaggacactgtatcccagccaggttcagtggcagtggtctggcacngagttcactntcaccatcancagcccgnagtcngaagtntttgctagttatactgtcagacaatanaaacagtgacattcactttcgccagggaccaaagtgatatcaaagactgtggctgcacatctgttcttcattccttcccncctatccttgtaacgttaacgtaacg

SEQ ID NO: 345015 - DNA, 494 bp, Homo sapiens
  misc_feature: GZ8MTXP01AZAU3.15.8.A08.1.454.CMB.2.raw
  modified_base (168)..(168): a, c, t, g, unknown or other
  misc_feature (168)..(168): n is a, c, g, or t
  modified_base (255)..(255): a, c, t, g, unknown or other
  misc_feature (255)..(255): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctccncatctatgctgcatccattagggacactggtatccccagccaggttcagtggcaggtgggtctggcacagagttcccactctcaccatcagcacgcccgnagtctagagtatttgctagtttatactgtcagcaatanaacagtgctatcgacgttcggccagggaccaaagtcggatatactaaacgactgtggctgcaccttgtctnttcttcnctcctccgcntcngtcgcgtaag

SEQ ID NO: 345016 - DNA, 524 bp, Homo sapiens
  misc_feature: GZ8MTXP01AF6XN.15.8.A08.1.454.CMB.2.raw
  modified_base (167)..(167): a, c, t, g, unknown or other
  misc_feature (167)..(167): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaanagccaccctctcctgcagggccagtcagagagttgccgccagtttagcctggtaccaacagaaacctggccagccctccaggctcctcatctatgctgcatccagttaggacactggtatccccagccaggttcagtggcaggtgggtctggcacgagagttcccactctccaccatccagccagccccgnagtctagaagtntttgctagtttatactgtcagacaatataacaagtcggacctaattctaccgtttcggacccgaagggaccctaaaggtggaactaatacgaaacgaactggtggcctggcacccatctgttcttcacttctcccgctatcttagcgcgtaacg

SEQ ID NO: 345017 - DNA, 625 bp, Homo sapiens
  misc_feature: GZ8MTXP01CLMEH.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctggtaaccaacagaaacctggccagccctcccaggctcctcatctatgctgcatccaagttagggaccacgtggtactccccagccaggttcaggtggctaggtgggtctggcacgagtacgtttccccactctaccaaccctataccaagcccaacggcccccgacgtagtccgtaggtaaagttcttttagtacttaagtttacttactgttacaagtactaaataataaacgaagtacggacctattacgtaccgtttaccgggacccgtaacgggtaaccgaaaggtacggaataacgtaaccgtaaaacgtaccgtggtacggtctcgacctaccttacttccgtcttccttcttaccttcccttccccgtcctactcgttacgtaacgttaacgttaacgg

SEQ ID NO: 345018 - DNA, 507 bp, Homo sapiens
  misc_feature: GZ8MTXP01BJD9G.15.8.A08.1.454.CMB.2.raw
  modified_base (168)..(168): a, c, t, g, unknown or other
  misc_feature (168)..(168): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (476)..(476): a, c, t, g, unknown or other
  misc_feature (476)..(476): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctatctatgctgcatccattagggacactggtatccccagccaggttcagtggcagtgggtctggcacgagtagttcacctctcacatcaagcngcccgnagtctgatnttttgctagtttatatgtacagtacaatataacaagtcgactattccacgtttcggccagggacctaagtgatatacaaacgtacgtgtacggctgcacctattctagtcttcgnttccttcccgcntcngagtcttaacgtaacg

SEQ ID NO: 345019 - DNA, 581 bp, Homo sapiens
  misc_feature: GZ8MTXP01AJVVD.15.8.A08.1.454.CMB.2.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaagagccaccctctcctgcagggccagtcagagagttgccgccagtttagcctggtaccaacagaaacctgccacgcctccaggctcctcatctatgctgcatccattagggacactggtactcccagccagttcagtggcagtgggtcnggcacagtgttcccactntccaccatccagcagccccganagtctagaaagttctttgctagtttacttactgtcagactaaataataacaaagtcggtacctatttccgtaccgtttccgggaccccgaaggggaacccgtaaagtggtaactaacgtaccgaaaacgtacctagggtcggctacggcctaacccgattccggttacttccttcttaccgtttcccttccccgccttaacgtccttcggtaacgttccgttaaccgg

SEQ ID NO: 345020 - DNA, 584 bp, Homo sapiens
  misc_feature: GZ8MTXP01EMSM5.15.8.A08.1.454.CMB.2.raw
  modified_base (168)..(168): a, c, t, g, unknown or other
  misc_feature (168)..(168): n is a, c, g, or t
  modified_base (376)..(376): a, c, t, g, unknown or other
  misc_feature (376)..(376): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaancgccaccctctcctgcagggccagtcagagagttgccgcctagtttacgcctggtaccaacagaaacctggccagcctccaggcctcctcatctatgctgctatccagttagggactacgtggtactcccagcctaggttcagtggcaggttggtctggacacgagtacgttccccacttctacaacatacaagccacggcccccganacgttctagggtaaatttcgttttagcttaagttttactacgttgtacaagtactaaattaactaaacgagtacgtacctatttaccgtacgtttccggacccgtagggaaccgaaagtggtaataactacgaaacgtacgtcgtaggctcgacaccttagtcttagttcttcttacttcctcccgctagtcttagtcgttcgtaacg

SEQ ID NO: 345021 - DNA, 566 bp, Homo sapiens
  misc_feature: GZ8MTXP01CH1JA.15.8.A08.1.454.CMB.2.raw
  modified_base (168)..(168): a, c, t, g, unknown or other
  misc_feature (168)..(168): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcttatctatgctgcatccattagggacactggtactcccagccaggttcagtggcaggtgggtctggcacagagttcacctctcaccatcaagcaacgcccganagtctagaacgtnttttgctagtttattactgtcagacaatataaacagtcgactattccgtacgtttccgggacccgtaacgggaaccctaaaggtcggaataagtaccgaaaacgtaacgtggtcgggctcgcacctacttcttacgtcctttacgttaccttccgttccccgacctaacttctcggacgtaaccgttaacggtaacgg

SEQ ID NO: 345022 - DNA, 597 bp, Homo sapiens
  misc_feature: GZ8MTXP01D0IZU.15.8.A08.1.454.CMB.2.raw
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (380)..(380): a, c, t, g, unknown or other
  misc_feature (380)..(380): n is a, c, g, or t
  modified_base (593)..(593): a, c, t, g, unknown or other
  misc_feature (593)..(593): n is a, c, g, or t
tcagtctacgtagccacgaccggtgctcgatttagcatactctacaggggtccctgagactctcctgtgccgcctctggagcagagtctgaattcaccttcatgcactttgccatgagctgggtccgccaggcgtccggggaaggggctggagtgcgtcgcatgtaataaactaaaagtggagacatcacactctacgcagactccgtgaagggccncttcaccatctccaganacaactcaaagaacacgctgtccctgganangaacagcctgagagccgagacacggctatttatactgtagacgaaagtnttaggttcggggaattaaattancgaataattacttattttgactccgtaggggaccaaggggacnccccgtgggtcctacccggtctccctacacgccctacccgaacccgaacgggcccacgttcccggtcccttcccccgtcggccctacccctcctacccaagacggccaccgtcgcggggccacgacgccggcccgtggctcgccgtggtaacaacggttacctaccgttccgcgtacgttacgcgttgaacggcggcgtcgggacagggtccngaag

SEQ ID NO: 345023 - DNA, 582 bp, Homo sapiens
  misc_feature: GZ8MTXP01CR8X7.15.8.A08.1.454.CMB.2.raw
  modified_base (168)..(168): a, c, t, g, unknown or other
  misc_feature (168)..(168): n is a, c, g, or t
  modified_base (372)..(372): a, c, t, g, unknown or other
  misc_feature (372)..(372): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttcgccgcctagtttagcctggtaccaacagaaacctggccagccctcccaggcctcctcatctatgctgcatccaagttagggacactggtactccccagcccaggtttcaggtggcagggttgggtctggcacgagtagttcccactctcaaccatacagccagccccgnagtctagaagtattttgacttagtttattactgtcagtactaataactaacagtcgacctattacgtaccgtttccgggacccgtaagggaaccctaaaggtcggtaataactacgtaaacgaacgttggcggtctacgctaccttagttcttgttccttcttaccttcccgttaccccgctatccgttagtaaccgttcgtttaaccgg

SEQ ID NO: 345024 - DNA, 547 bp, Homo sapiens
  misc_feature: GZ8MTXP01CMZEX.15.8.A08.1.454.CMB.2.raw
  modified_base (168)..(168): a, c, t, g, unknown or other
  misc_feature (168)..(168): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (498)..(498): a, c, t, g, unknown or other
  misc_feature (498)..(498): n is a, c, g, or t
  modified_base (521)..(521): a, c, t, g, unknown or other
  misc_feature (521)..(521): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccagttagggacacgtggactcccagccaggttcagtggcaggtggtctggcacgagtacgttcccactctcaccatcagcacgcccgntagtctagaagtntttgctagtttatacgtgtacagtactaataataaacagtcggactattccgtacgtttccggacccgtaagggaacctaaaggtggtaataacactaaacgactggtgcgtcgctaccttatcgttnttccgttcacttcccttaccccnctactcgttacgtaacgttcgtaacg

SEQ ID NO: 345025 - DNA, 549 bp, Homo sapiens
  misc_feature: GZ8MTXP01AVLOX.15.8.A08.1.454.CMB.2.raw
  modified_base (168)..(168): a, c, t, g, unknown or other
  misc_feature (168)..(168): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
  modified_base (527)..(527): a, c, t, g, unknown or other
  misc_feature (527)..(527): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttacgcctggtaccaacagaaacctggccagcctccaggctcctcatctatgctgcatccagttagggacacgtggtactccccagccaggttcaggtggcaggtgggtctggcacgagagttcccactctcaccatcagcagcccgnagtctagaaagttntttgacttagtttacttacgtgtacagtactaaataataacgagtcgtactacttccgtacgttccggaccgaacgggtaacgtaaggtagaactaactaacgtaaacgtacgtggtgctcgcacttgtctcttcttcttcttccctcccgctntcgttacgtaacgttcgtaacg

SEQ ID NO: 345026 - DNA, 520 bp, Homo sapiens
  misc_feature: GZ8MTXP01CZGVM.15.8.A08.1.454.CMB.2.raw
  modified_base (371)..(371): a, c, t, g, unknown or other
  misc_feature (371)..(371): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctatgctgcatccattagggacactggtactcccagccaggttcaggtggcaggtgggtctggcacgagagttcccactctcacccatccagcacgcccgcagtctagaatnttttgctagtttattactgtacagcaatataacaagtgacctattctacgtttcggaccctaagggacccaaagtcggataatacaaacgactgtggctgcaccttatctgttcttcacttccttcccgctatcttgtaacgcgtaacg

SEQ ID NO: 345027 - DNA, 630 bp, Homo sapiens
  misc_feature: GZ8MTXP01CO3NY.15.8.A08.1.454.CMB.2.raw
  modified_base (168)..(168): a, c, t, g, unknown or other
  misc_feature (168)..(168): n is a, c, g, or t
  modified_base (256)..(256): a, c, t, g, unknown or other
  misc_feature (256)..(256): n is a, c, g, or t
  modified_base (356)..(356): a, c, t, g, unknown or other
  misc_feature (356)..(356): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctaggtaccaacagaaacctggccagcctccaggctcctnatctatgctgcatccagttagggcacgtggtactccccagccaggttcagtggcaggtggctggcacagagttccactctcaccatccagcacgccccgnagtctagaaacgtattttgacttagtttacttacgtgttacagtacctaaatactaaacgagtcgtacctagtttccgtacgtttcccgggacccgtaacgggggaaccctaaaaggtcgggtaaacttaacgtaaccgtaaaaccggtaacgttcgggtaacggggtccttacgggaccctaacccgttatttacccgttgttacccgtttcgttaccttcccctttaccccggaacttacttacgttacggtaaccgttccgtttaaccggg

SEQ ID NO: 345028 - DNA, 496 bp, Homo sapiens
  misc_feature: GZ8MTXP01EIINU.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggcactggatcccagccaggttcagtggcagtgggtctggcacagagttccactctcaccatcagcagcccgcagtctgaagatttgcagtttatactgtcagcaaatataaacaagtggccattcaacttttcggccccaagggaccaaaagtggaataatcaaaacgaactgtgggctgcaccatctgttcttcatcttcccgcatcttgtgctaacg

SEQ ID NO: 345029 - DNA, 528 bp, Homo sapiens
  misc_feature: GZ8MTXP01EGHLJ.15.8.A08.1.454.CMB.2.raw
  modified_base (168)..(168): a, c, t, g, unknown or other
  misc_feature (168)..(168): n is a, c, g, or t
  modified_base (261)..(261): a, c, t, g, unknown or other
  misc_feature (261)..(261): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaacagaaacctggccagcctccaggctctatctatgcngcatccattagggacactggtatcccagccaggttcagtggcagtgggtcnggcacngattcactctcacatcaagcngcccgnagtctagaagttntttgatagtttatactgtacagtactaataataacgagtcgactattcctacggtttccggaccgtaacgggaccgaaagtgattacgtaacaaacgtacgtgtcgctcgcactattcgtcgtcttacttcttcccttcccgctaactcgtagacgtccgttaacgtaag

SEQ ID NO: 345030 - DNA, 500 bp, Homo sapiens
  misc_feature: GZ8MTXP01CKKTG.15.8.A08.1.454.CMB.2.raw
  modified_base (351)..(351): a, c, t, g, unknown or other
  misc_feature (351)..(351): n is a, c, g, or t
  modified_base (468)..(468): a, c, t, g, unknown or other
  misc_feature (468)..(468): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctccaggctcctcatctatgctgcatccattagggacactggtatcccagccaggttcagtggcagtgggtctggcacagagttcccactctcaccatcagcagcccgnagtctagaagtattttgctagtttattactgtcagacaaatataaacaagtcggcctattcactttcggacccagggaccaaagtgataatcaaacgactgtggctgcaccatcttnttcttcncttcctccgctntcttgtgcgtaag

SEQ ID NO: 345031 - DNA, 520 bp, Homo sapiens
  misc_feature: GZ8MTXP01A7GVL.15.8.A08.1.454.CMB.2.raw
  modified_base (364)..(364): a, c, t, g, unknown or other
  misc_feature (364)..(364): n is a, c, g, or t
  modified_base (446)..(446): a, c, t, g, unknown or other
  misc_feature (446)..(446): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctccaggctcctcatctatgctgcatccagttagggacactggtactcccagccaggttcagtggcaggtggtctggcacgagtacgtttcccacttctcacccagtccagcacgccccgnacgtctagaagtattttgcttagtttattactgtacagacaatataacagtcgactattcacttccggccgagggaccaagngatatactaacgactgtggctgcacatctacgttcttcacttccttcccgctactcttacgcgttcgttaacgg

SEQ ID NO: 345032 - DNA, 607 bp, Homo sapiens
  misc_feature: GZ8MTXP01BR2S7.15.8.A08.1.454.CMB.2.raw
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaactggccagcctccaggctctcatctatgctgcatccagttaggacactggtactcccgagccaggttcagtggcaggtggtctggcacagtacgttccactctacacntaccagccagcccgnacgtctagagtntttcgctagtttatactgtacaagtactaaatactaaacagtcggacctagttaccgtacgtttccggacccgtaacgggaaccaaaggtcggaaatacgtaaccgaaaacgtaacgtgtcgggcttacggacctaaccgttacttccgttcggtttaccgtttccgttaacgtttcccctttaccccggtaacccttaacgttcccgttaaggtaaccggttaaccgtttaaaccgggg

SEQ ID NO: 345033 - DNA, 618 bp, Homo sapiens
  misc_feature: GZ8MTXP01D6MOY.15.8.A08.1.454.CMB.2.raw
  modified_base (167)..(167): a, c, t, g, unknown or other
  misc_feature (167)..(167): n is a, c, g, or t
  modified_base (256)..(256): a, c, t, g, unknown or other
  misc_feature (256)..(256): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaanagccaccctctcctgcagggccagtcagagagttgccgcctagtttacgcctaggtaccaacagaaacctggccagcctccagctcctnatctatgctgcatccagttacgggactactggtaactccccagcctaggttcagtggcgtaggttgggtctggcacgagtacgtttcccaccttctaccacctactaccaagcccaacggccccgactaggttccgtaggtaaacgtttattttcgactttaaggtttacttaacgtgtacaagtactaaataactaaacgtaagtcggaccttacgttacctaacgtttccgggacccgaacgggtaaaccgaaagtcgtaataactaactaaacgtacgtggtcggctcgacctaccttagttcgtcttacttccttacttcccttcccgctacgtccgttagtaaccgttcgttaacgg

SEQ ID NO: 345034 - DNA, 593 bp, Homo sapiens
  misc_feature: GZ8MTXP01EEPML.15.8.A08.1.454.CMB.2.raw
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccaccctctcctgcagggccagtcagagagttgccgcagtttagcctgtaccaacagaaacctggccacgcctccaggctcctcatctatgctgcatccagttagggactacgtggtactccccagcctaaggttcaggtggctaggttgggtctggcacgagtcgttccactctacacatcagcacgccccgnagtctagaattatttgcttagtttatactgtacagactaaatataacaagtcgactacttacgtacgtttcggcccgtaaggaacctaaaggtggtaataacgttaaccgaaaacgtacgttaggtcgtcgtcgacctaaccttacttaccgttcgtttccctttcttaccgttcccctttacccgtccttaacgttccgttacggtaacgttccgtttaaaccggg

SEQ ID NO: 345035 - DNA, 529 bp, Homo sapiens
  misc_feature: GZ8MTXP01DDT5J.15.8.A08.1.454.CMB.2.raw
  modified_base (168)..(168): a, c, t, g, unknown or other
  misc_feature (168)..(168): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
  modified_base (504)..(504): a, c, t, g, unknown or other
  misc_feature (504)..(504): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaacagaaacctggccagccctcccaggctcctcatctatgctgcatccattagggacactggtactcccagccaggttcagtggctaggtggctggcacngagttccacttcncaccatcagcagcccgnagtctagaatatttgactagtttatactgtacagactaatataacaagtcgactattcgtacgtttccggacctagggaacctaaaggtggaataatacaaacgtactgnggtaactgcaccngttactgttcttcacttccgttaccccnctactcgttcgtaacgttcgtaacg

SEQ ID NO: 345036 - DNA, 555 bp, Homo sapiens
  misc_feature: GZ8MTXP01AFBRT.15.8.A08.1.454.CMB.2.raw
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaaccaacagaaacctggccagcctcccaggctcctcatcatgctgcatccattacgggacacgtggtactcccagccgaggttcaggtggcaggtgggtctggcacgagtacgttcccactctcaccatcagcacgcccgnagtctagaagtatttgactagtttacttactgtcagactaataataacgaagtacggacctattccgtacgtttccgggacccgtaacggggaacctaaagtggaatacgtacaaacgtaactggtacggctcgctaccattcgtcgttacttcacttccttccccgctactcgttagaacgttccgtaacgg

SEQ ID NO: 345037 - DNA, 616 bp, Homo sapiens
  misc_feature: GZ8MTXP01DW7N3.15.8.A08.1.454.CMB.2.raw
  modified_base (168)..(168): a, c, t, g, unknown or other
  misc_feature (168)..(168): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccagttagggacactggtactcccagccaggttcagtggcaggtggtctggcacagtagttcccactctcaccatcagccacgccccganacgtctagaacgttntttgactagtttactactgtacagactaaatataacagtcggtacctacgtttccgtaacgttttcccgggacccgtaacgggaaaccctaaaggtcggtaaattaaacgttaaccgaaaacgtaaccgttgggtcgggtcttacggaccctaaccttaacttcccgttcgtttacccttccttaaccgttcccctttaccccggccttaacgttccttacggtaacgttccgtttaaaccgg

SEQ ID NO: 345038 - DNA, 538 bp, Homo sapiens
  misc_feature: GZ8MTXP01AV0HX.15.8.A08.1.454.CMB.2.raw
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (379)..(380): a, c, t, g, unknown or other
  misc_feature (379)..(380): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccaccctctcctgcagggccagtcagagagttgccgccagtttagcctggtaccaacagaaacctggccagccctcccaggcctcctcatctatgcttcatccattacgggacacgtggtactcccagccaggttcaggtggcaggtgggtctggcacgagagttcacctctcacntcaagcncgcccgnagtctagaagttntttnnttattatactgtcagactaataataacagtcgactattcctacggttcggaccgtaggaacgaagtagatactaacaaacgtactggtcgctaacgccttactattcgttacgttcttacttcttccctcccgctcgtctacgactcgttaacgtaag

SEQ ID NO: 345039 - DNA, 641 bp, Homo sapiens
  misc_feature: GZ8MTXP01CLODK.15.8.A08.1.454.CMB.2.raw
  modified_base (168)..(168): a, c, t, g, unknown or other
  misc_feature (168)..(168): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccagttaggacactggtactcccagccaggttcaggtggcaggtgggtctggcacgagtagttcccactctacaccatcaacgccacgccccgntagtctaggtaaactattttgacttagtttacttacgtgttacaagtacaaattactaaacgtaacgtcggtacctacgtttccgtacgttttcccgggacccgtaacggggtaaccctaaaggttcggaattaacgtaccgaaaacggtaccgttggtcgggtccttacggacctaaaccccgttgtttaacccttcggtttccctttaccaaccgttttcccctacccccggtaaccttaacttccggttacggtaacgttaaccgtttaaaccggg

SEQ ID NO: 345040 - DNA, 517 bp, Homo sapiens
  misc_feature: GZ8MTXP01DPP49.15.8.A08.1.454.CMB.2.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaagagccaccctctcctgcagggccagtcagagagttgccgcagtttagcctggtaccaacagaaacctggccagcctcccaggctcctcatctatgctgcatccattaggacactggatcccagccaggttcagtggcaggtggtctggcacagattccactncaccatcagcagccccgnagtctagaatntttgatagttatactgtacananaataanaacaagtagactactacgtacgttcgtaccgacggaacgaaagtagataatactaaacaacgtagtgcgtcgcacactctcgttcttcttacttccttcccgtccctactcttacgtaacgttcgtaacg

SEQ ID NO: 345041 - DNA, 530 bp, Homo sapiens
  misc_feature: GZ8MTXP01BSSGD.15.8.A08.1.454.CMB.2.raw
  modified_base (168)..(168): a, c, t, g, unknown or other
  misc_feature (168)..(168): n is a, c, g, or t
  modified_base (365)..(365): a, c, t, g, unknown or other
  misc_feature (365)..(365): n is a, c, g, or t
  modified_base (476)..(476): a, c, t, g, unknown or other
  misc_feature (476)..(476): n is a, c, g, or t
  modified_base (491)..(491): a, c, t, g, unknown or other
  misc_feature (491)..(491): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctggtaaccaacagaaacctggccagcctccaggcctcctcatctatgctgcatccagttacgggacactggtactccccagccaggttcagtggcaggtgggtctggcacgagtacgttccactctacaccatcagccacgccccgntacgtctagaaagttcttttgactagtttatactgtacagtactaatataacgagtgacctattcgtacgtttccggaccaggaaccaagtggatactacaaacgactggnggctgcacttatctnttccttcttctccctcccgcatcgttgtaacgcgtaacg

SEQ ID NO: 345042 - DNA, 541 bp, Homo sapiens
  misc_feature: GZ8MTXP01B40G6.15.8.A08.1.454.CMB.2.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgccaccctctcctgcagggccagtcagagagttgccgcctagtttagcctggtaaccaacagaaacctggccagcctcccaggctcctcatctatgctgcatccattagggacactggtactccccagccaggttcaggtggcaggtgggtctggcacagagttccactctcaaccatcagcacgtcccgnagtcnggaaattnttnatagttatactgacanataataataacgtagtacgactacttacgtacgttacgtaccgacggaacgtaagtagagtaactaacgtaaacgaacgtacgtgtcgtcgcacacgtctcttcttcttactcctccctcctctcttacgtaacgttaacgtaacg

SEQ ID NO: 345043 - DNA, 572 bp, Homo sapiens
  misc_feature: GZ8MTXP01DV0G7.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttcgccgcctagtttacgcctaggtaaccaacagaaacctgggcccacgccctacccgaggtcctcctcatctatgctgcatccagttagggacctacgtggtaactcccgagccgtaggttcaggtggctagggttggtctggccagagtacgttccactctacaccatacagccacgccccgatagtctagagttatttcgctagtttatacgtgtacagtactaataataacagtcgactattacgtacgtttccggaccgagggtaacaacgtgactaatacgtaaacgtacgtggtcgcgtcgactacttacttcgtcttcttcttacttcccgtcccgtctactcttacgtaacgttcgttaacgg

SEQ ID NO: 345044 - DNA, 534 bp, Homo sapiens
  misc_feature: GZ8MTXP01AXY0W.15.8.A08.1.454.CMB.2.raw
  modified_base (167)..(167): a, c, t, g, unknown or other
  misc_feature (167)..(167): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (519)..(519): a, c, t, g, unknown or other
  misc_feature (519)..(519): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaanagccaccctctcctgcagggccagtcagagagttgccgccagtttagcctggtaccaacagaaacctggccagcctccaggctcctcatctatgctagcatccagttagggactacgtggtactccccagcctaggttcaggtggcaggtgggtctggctacgagacgtttccactctcaccatcagcagccccgntagtcagaacgtntttgctagtttatactgtacagctaaatactaactaagtcgcctaattcgtaacgtttcgggaccctaaggggaacccaaaggtggaatagtacaaacgactggtcgctgcaccagtctgttcttcattcctccccgctactnttcgcgttcgtaacg

SEQ ID NO: 345045 - DNA, 549 bp, Homo sapiens
  misc_feature: GZ8MTXP01CEK1E.15.8.A08.1.454.CMB.2.raw
  modified_base (497)..(497): a, c, t, g, unknown or other
  misc_feature (497)..(497): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagagcccacctctcctgcagggccagtcagagagttgccgcctagtttagcctaggtaaccaacagaaacctggccagccctcccaggcctcctcatctatgctgcatccagttaggcatggtactcccagccaggttcaggtggactagggtggtctggactacgagacgtttccccactctacaccatcaacgcaacgccccgatacgtctaggtaatatttgactagtttatactgtcagactaatataacaagtgactattcgtactttccgccgtagggaaccaaaggtgaattaacacgaaacgagtcgaggtctagcaaccntactcgttcttcttacttcccttcccaactactcttagtaacgttcgtaacg

SEQ ID NO: 345046 - DNA, 738 bp, Homo sapiens
  misc_feature: GZ8MTXP01BXDXL.15.8.A08.1.454.CMB.2.raw
  modified_base (169)..(169): a, c, t, g, unknown or other
  misc_feature (169)..(169): n is a, c, g, or t
  modified_base (393)..(393): a, c, t, g, unknown or other
  misc_feature (393)..(393): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgcctagtttagcctggtaaccaacacgaaacctggccagcctccgaggcctcctcatctatgctgcatccagttacggacacgtggtactcccgagcctaggttcagtcggctaggtcgggtctggacacgagtacgttcccaactctaccgaaccactacgaacgccgaaacgcccccgggtanacgttccgttaagggaaacgtttagtttttacgactttaaggtttttaacttacgttacggttactaaacggtaacctaaattaacgttaaaacgaaacgggttacggacccttaacgtttaccgtaaccggtttttacccggggaaccccgaaacggggtaaacccgtaaaaggttacggtaaattaaaccgtaaacgtaaaacccggtaaagttccgggttaggtaaccttcggaaccctaacccgttaacgtttccgttaccggtttaccgttaccgttacctttccccgtttaccccggaacctacgttaccgttacggtaacgttaaccgttaaaccggg

SEQ ID NO: 345047 - DNA, 550 bp, Homo sapiens
  misc_feature: GZ8MTXP01DRQFM.15.8.A08.1.454.CMB.2.raw
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
tcagtctacgtagccacgaccggtgctcgatttagcatactctacagggtggctggagctgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagcctccaggctcctnatctangctgcatccagttaggacatggactcccagccaggttcagtggcaggtgggtcnggcanagcttccactcncaccatccagcagccccganagtctagaagttattttgacttagtttattactgtacaagactaaataataaacgaagtcggtacctacttcgtaccgtttaccggacccgaacgggaaccaaaggtggtaattaaactacaaacgtaactggtaggctgactaccttatctacttcttcttactcccttcccgcctatcttagtaacgttcgtaacg

SEQ ID NO: 345048 - DNA, 524 bp, Homo sapiens
  misc_feature: GZ8MTXP01B66MY.15.8.A08.1.454.CMB.2.raw
  modified_base (168)..(168): a, c, t, g, unknown or other
  misc_feature (168)..(168): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaacagaaacctggccagcctccaggctcctcatctatgctgcatccaagttagggacactggtactccccagccaggttcaggtggcaggtgggtctggcacagtacgttcccactctcaccatcagcacgccccgntagtctagaatatttgctagtttatactgtcagacaataataacaagtcgacctacttcgtacgtttccggacccgaagggaaccaaagtgaatactactaaacgactgtggctgccacgatctgttcttcacttcctcccgctactcgttgtaacgcgtaacg

SEQ ID NO: 345049 - DNA, 493 bp, Homo sapiens
  misc_feature: GZ8MTXP01AR0EN.15.8.A08.1.454.CMB.2.raw
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatccccagccaggttcagtggcagtgggtctggcacagacttccactctcaccatcagcagccccgnagtctgaatntttgctagtttatactgtcagcaatataacagtgctatcgactttcggccagggaccaagngataactcaaacgtaactgtggctcgcaccatctgttccttcactccttccgccatcttgcgcgtaacg

SEQ ID NO: 345050 - DNA, 578 bp, Homo sapiens
  misc_feature: GZ8MTXP01BPQ59.15.8.A08.1.454.CMB.2.raw
  modified_base (168)..(168): a, c, t, g, unknown or other
  misc_feature (168)..(168): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgcctagtttagcctggtaccaacagaaacctggccagcctcccaggcctcctcatcatgctgcatccagttagggacactggtactccccagcctaggttcaggtggcaggtgggtctggcacgagtagttcccacttctcaccatccagcacgcccgnagtctagaatntttgctagtttatactgtactagactaatactaaacgagtcggacctacgttaccgtacgtttcccgggacccgtaacgggaaccctaaaggtcggtaactaacgtacgtaaacgtaacgtcggtacggcctagacctacgttacttacgtcgttcttccacgttcccttcccgcctacgtcttacggtaacgttcgttaacgg

SEQ ID NO: 345051 - DNA, 588 bp, Homo sapiens
  misc_feature: GZ8MTXP01CU5W3.15.8.A08.1.454.CMB.2.raw
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (563)..(563): a, c, t, g, unknown or other
  misc_feature (563)..(563): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagacgccaccctctcctgcagggccagtcagagagttgccgcctagtttagcctggtaccaacagaaacctggccagcctcccaggctcctcatctatgctgcatccattacgggcactggtactcccagccaggttcaggtggcaggttgggctggcacgagtacgttcccactctcacccataccagcacggtccccgntagtctagaaacgtttntttagtacttagtttacttactgtcaagtactaataacaacgtacgtacgtacctacgttaccgtacgttccgggaccgaacgggaaccgtaaaggtcgtaactaacgtaaccgtaaacgtacgtcggtcgtctacgacctaccttacgttcgttcttccgttccttacttccctcccnctctcgttacgtaacgttcgtaacg

SEQ ID NO: 345052 - DNA, 671 bp, Homo sapiens
  misc_feature: GZ8MTXP01AWCVZ.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangcccaccctctcctgcagggccagtcagagagttgccgcctagtttagcctaggtaccaacagaaacctggccagccctcccgaggcctcctcatctatgctgcatccagttacgggacacgtggtactccccgagcccgaggttcaggtcggcagggttcggggtctgggacaacgaggtacgtttccccacttctacaaccataccagcacggccccgatacgtctaggaagttatttcgacttaggtttacttacgttgtactaagactaaatacgtaaacgtagtcggtactacgttaccggtaaccgtttccggggaaccccgtaacgggtaaaccctaaaggtacggtaaactttaacgtaaaccgtaaaaccgtaacgttacggtcgggcttaaccggacctaaccttacgtttccgttaacgttccctttacttacccgtttcccttaccccggtcttaacgttccgttacgtaaccgttaaccgtttaacggg

SEQ ID NO: 345053 - DNA, 608 bp, Homo sapiens
  misc_feature: GZ8MTXP01COPUI.15.8.A08.1.454.CMB.2.raw
  modified_base (378)..(378): a, c, t, g, unknown or other
  misc_feature (378)..(378): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttagcctggtaccaacagaaacctggccagcctcccaggcctcctcatctatgctgcatccagttacgggactactggtactccccgagccctaggttcaggtggactaggtggggtctggcaacgagtacgtttccccactctccaaccatcagcacgccccgnaggtctagaagtattttgactagtttactacgtgtacagactaaatactaacgtaagtcggtacctacgtttaccgtaccgttttcccgggacccgaagggggaaaccctaaaaggttggaacttaactacgaaaacgtaaccgtggtacgggctacggaccaacccttagttctcgttacgttcactttcccttccccggctaacgtcttacggaacgttccgtaacgg

SEQ ID NO: 345054 - DNA, 499 bp, Homo sapiens
  misc_feature: GZ8MTXP01DXQ4D.15.8.A08.1.454.CMB.2.raw
  modified_base (168)..(168): a, c, t, g, unknown or other
  misc_feature (168)..(168): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (467)..(467): a, c, t, g, unknown or other
  misc_feature (467)..(467): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccgnagtctgaagtntttgctagtttatactgtcagacaatataacaagtggacctattcacgtttcggacccgtaagggaccaaagtggatatacaaacgactgtggctgcaccatctnttcttcactcttcccgctatcttgtgctaacg

SEQ ID NO: 345055 - DNA, 657 bp, Homo sapiens
  misc_feature: GZ8MTXP01A1ZRR.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctatgctgctactacctaagttacgggactacgtggtacctcccgagccgtaggttcaggtcggctagggtggtcgtggcaacgaggtacttccccaccttctaccacctataccgacgccgacgccccgatacgtcgtaggtaaagtttcttttcgactttaaggttttaactacgttcgtacgaacgtactaaataactaaacgtaggtcgtaccttacttaccgttaccgtttaccggacccggtaaacgggtaaaccgtaaaggtggtaaacttaacgtaaaccgaaaaccgtacgtggtcggtaacctgaccctaaccttacgttccttacgttcctttcgaccctttccccgtacccgtaactacttcgttacgtaacgttccgttaaacgg

SEQ ID NO: 345056 - DNA, 567 bp, Homo sapiens
  misc_feature: GZ8MTXP01C71NT.15.8.A08.1.454.CMB.2.raw
  modified_base (168)..(168): a, c, t, g, unknown or other
  misc_feature (168)..(168): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (476)..(476): a, c, t, g, unknown or other
  misc_feature (476)..(476): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccagttacgggactacgtggtactccccagccctaggtttcaggtggctaggttgggctggcacgngtacgttccactctcaccntccagcacgcccgntagtctaggaatntttgctagtttatactgtacaagtacaaatataaacaagtcggacctacttcgtacgtttccggacccgaagggaacctaaagtcggattaaacncgtaaaacgtactggtagcgtcgcctacccttagtcttcgttcttccactttcccttacccgccttactccgttagtaacgcgtttaacgg

SEQ ID NO: 345057 - DNA, 550 bp, Homo sapiens
  misc_feature: GZ8MTXP01DRKTN.15.8.A08.1.454.CMB.2.raw
  modified_base (169)..(169): a, c, t, g, unknown or other
  misc_feature (169)..(169): n is a, c, g, or t
  modified_base (390)..(390): a, c, t, g, unknown or other
  misc_feature (390)..(390): n is a, c, g, or t
  modified_base (485)..(485): a, c, t, g, unknown or other
  misc_feature (485)..(485): n is a, c, g, or t
  modified_base (509)..(509): a, c, t, g, unknown or other
  misc_feature (509)..(509): n is a, c, g, or t
  modified_base (526)..(526): a, c, t, g, unknown or other
  misc_feature (526)..(526): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttagcctaggtaaccaacaagaaacctggccagccctcccaggcctcctcatctatgctgcatccagttacgggactactggtactcccgagcctaggttcaggtggctaggttcgggggtctggcaacgaggtactttccccactctaccaacccatccaagccgaacgcccccgntaagtcctagaaagttacttttgacttagtttatactgtacaagtacaaataataacaagtgactattcgtacttcgaccaggaccaagtgatanacaaacgatgtgctgcacagtctnttcttcactccttcccncctatccgttagaagccgttaagg

SEQ ID NO: 345058 - DNA, 728 bp, Homo sapiens
  misc_feature: GZ8MTXP01DAO83.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccaccctctcctgcagggccagtcagagagttcgccgcctagtttagcctggtaccaaacaacgaaaccgtcggccacgccctcccaggcctcctcatctatgctgcactccagttagggacacgtggtactccccagccgtaggttcaggtggctaggtggtctggcaacgagtacgttcccaccttctcacctataccgacgccgaacgccccgtactacggtcgtaggtaaacgtttacgttttacgtactttaaggttttacttacgttgttacgtaagtacctaaattaaactaaacgtaacggttcggtaccttactttaccggttacccgtttttacccggggaaccccggtaacggggtaaacccgtaaagggttacggttaaacttaaacgttaaaccgaaaaccggttaaacgttcgggttaacgggtcctacggttaccctaaacccgttactttcccgttcgtttacccgtttccgttaacctttccccgtttaccccgtaaccttaacttccgttacggtaacgttaacccgtttaaaccggg

SEQ ID NO: 345059 - DNA, 729 bp, Homo sapiens
  misc_feature: GZ8MTXP01ERT7S.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccaccctctcctgcagggccagtcagagagttgccgctagtttacgcctggtaccaacagaaacctggccacgccctccaggcctcctcatctatgctgcatccagttagggacacgttggactcccgagccgtaggttcaggtggcagggttgggtctggacacgagtacgttcccactcacaccatcgaagccgacgccccgatacgttctaggtaaacgtttgttttacgacttaaggttttacttacgttacgtacgtaacgtaacctaaattaaacgtaaacgtaacgggttacggtacccttaacgtttacccggttaaccggtttttaccccggggaaccccgtaaaccgggggtaaacccgtaaaacggttagggtaaaacttaaaccgttaaaccgaaaaccggttaaacgttacgggttaccgggtaaccgttacggacccgtaaacccgttaacgttccttacggtttaccctttccgttaacctttccccgttaccccgtaaccgtaacttccggttacggtaaccgtttaaccgttaaaccggg

SEQ ID NO: 345060 - DNA, 605 bp, Homo sapiens
  misc_feature: GZ8MTXP01C5818.15.8.A08.1.454.CMB.2.raw
  modified_base (169)..(169): a, c, t, g, unknown or other
  misc_feature (169)..(169): n is a, c, g, or t
  modified_base (389)..(389): a, c, t, g, unknown or other
  misc_feature (389)..(389): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcaggccagtcagagagttgccgcctagtttacgcctaggtaaccaacagaaacctggtcacgcctccaggctcctcatctatgctgcatccagttacggactacgtggtaactcccagccagggttcaggtcggctaggttcgggtctggcaacgagtacgttccactctcacatcagccacgtcccgataggtctaggtaatntttgctagtttacttactgtacagtactaataactaacaagtcggtacctacgttaccgtacgtttcccggacccgtaaacgggaacctaaaggtacggaataacgtaacgtaaaacgtactacggtggtaactcgacctaccttaacgttcgttcgttaccttcttaccttcccgtaccccgaactacgtccgttacgtaacgttccgttaacgg

SEQ ID NO: 345061 - DNA, 581 bp, Homo sapiens
  misc_feature: GZ8MTXP01ENM6J.15.8.A08.1.454.CMB.2.raw
  modified_base (169)..(169): a, c, t, g, unknown or other
  misc_feature (169)..(169): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
  modified_base (559)..(559): a, c, t, g, unknown or other
  misc_feature (559)..(559): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttgccgcagtttagcctgtaccaacagaaacctggccagcctccagctcctcatctatgctgcatccagttagggactacgtggtactcccgagtccgtaggtttcaggtcggcgtaggtttgggtcctggcaacgagtacgtttcccactctacacccgataccagcacgccccgnagttctagaaagtttntttgtacttagttatacgtgtactagtaactaaataactaacgagtacgtactacttaccgtacgttccggaccgtaacggaacgtaaagtcgtaataactaacgtaaacgtacgtcggngtcgtcactacacgttcgttcgttcttcttacttcctcccgctntcgttacgtaacgttcgtaacg

SEQ ID NO: 345062 - DNA, 560 bp, Homo sapiens
  misc_feature: GZ8MTXP01BGM45.15.8.A08.1.454.CMB.2.raw
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (512)..(512): a, c, t, g, unknown or other
  misc_feature (512)..(512): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctccaggctcctcatctatgctgcatccattaggacactggtactcccagccagttcaggtgcaggtggtctggcacagtcgttccactctacaccntacagcagcccgnacgtctagattatttgcttagttactactgtacagactaaatataacagtcgactacttaccgtacgtttaccgggaccccgtaagggtaacccaaaggtcggaataacgtaaccgtaaaacgtacgtaggtcggtaactggacctacccttattccgtnttccttccttacttcccttcccgccttatcgacgtaacgttcgtaacg

SEQ ID NO: 345063 - DNA, 542 bp, Homo sapiens
  misc_feature: GZ8MTXP01B27YM.15.8.A08.1.454.CMB.2.raw
  modified_base (168)..(168): a, c, t, g, unknown or other
  misc_feature (168)..(168): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggcctcctcatctatgctgcatccagttagggacacgtggtactcccagcctaggttcaggtggcagggtgggtctggcacgagtacgttcccactctcacccatcagccacgccccgnagtctagaagttntttgtctagtttatatgtcagactaatataacagtcggacctacttacgtacgtttccggaccgaacgggaaccaaagtggaataacactaaacgaactgtggctgcctacatctgttcttcttacttcctcccgtctacgtcttacgtcgttcgtaacgg

SEQ ID NO: 345064 - DNA, 568 bp, Homo sapiens
  misc_feature: GZ8MTXP01C2PN9.15.8.A08.1.454.CMB.2.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccagttacgggacactggtactccccagccaggttcagtggcagttgggctggcacngagttccactctcaccatccagcagccccgnagtctgaagtctttgctagtttattactgttcagacaatataacaagtggacctatttcgtaccgttttacggacccgtaacggggaacctaaaggtggaataacgtactaaaccgtaacgtggttggctcggacctaccacttccgttcgttccgtttcttaacttccctttacccgccttacgtccgttacgaacgttccgtttaacgg

SEQ ID NO: 345065 - DNA, 632 bp, Homo sapiens
  misc_feature: GZ8MTXP01C9RFG.15.8.A08.1.454.CMB.2.raw
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgcccaccctctcctgcagggccagtcagagagttgccgcctagtttacgcctaggtaaccaacagaaacctggacccagccctcccaggcctcctcatctatgctgcatccagttacgggactacgtggtactccccgagcccgtaggttcaggtggctagggttgggtctggaccacgagtacgtttcccaccttctacaccataccagccacgcccganagtcaggaattntttgacttagtttacttacgtgtacagtactaataataaacgagtcgactacttcgtacgtttaccggacccgtaacggggaacctaaaggtggtaattaactacgtaaaacgtacgtcggtcgggcttcggacctaaaccgttctttaccgttcgttcctttcttacctttccccgttaccccgtaacccttagttccgttacgtaacgttaaccgtttaaacggg

SEQ ID NO: 345066 - DNA, 583 bp, Homo sapiens
  misc_feature: GZ8MTXP01C40FF.15.8.A08.1.454.CMB.2.raw
  modified_base (168)..(168): a, c, t, g, unknown or other
  misc_feature (168)..(168): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctccaggcctcctcatctatgctgcatccagttagggacactggtactccccagccaggttcaggtggctaggtgggtctggcacgagacgtttcccactctcaccatcagccacgcccgnagtctaggtaaacttattttcgacttagtttacttacgtcgttacacgtaactaataataacgtagtcgtactacttcgtacgtttaccggaccgtaacgggaacctaaaggtgaataacgtacgaaaccgtagtacggtcggtctacgacctaccttacgttctacgttccttcttaccttcccttcccgcctatcgttacgtaacgttcgttaacgg

SEQ ID NO: 345067 - DNA, 534 bp, Homo sapiens
  misc_feature: GZ8MTXP01DSTPN.15.8.A08.1.454.CMB.2.raw
  modified_base (325)..(325): a, c, t, g, unknown or other
  misc_feature (325)..(325): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagccctcccaggcctcctcatctatgctgcatccattagggacactggtatccccagccaggttcagtggcaggtgggtctggcacngagttcccactctacaccatcagcagccccgaacgtctagaagtatttgactagtttattactgtcagcaaatataaacagtggacctattccgtactttccgggacccaaggggaacccaaagtcggaattacgtaacaaacgaactggtggctgctaccatcgtgttccttcacttccttcccgcctatcttagaacgttcgtaacg

SEQ ID NO: 345068 - DNA, 536 bp, Homo sapiens
  misc_feature: GZ8MTXP01BXDR9.15.8.A08.1.454.CMB.2.raw
  modified_base (169)..(169): a, c, t, g, unknown or other
  misc_feature (169)..(169): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (480)..(480): a, c, t, g, unknown or other
  misc_feature (480)..(480): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttagcctggtaccaacagaaacctggccacgcctccaggctcctcatctatgctgcatcccagttacgggacacgtggtactccccagccaggttcagtggcaggtggtctggcanagacgttcccactctcaccatcagcacgccccgnagtctaggaacttntttgcttagtttacttactgtacagactaaatataaacaagtcgactattccgtacgtttccggacccgaagggaaccaaagtgaatatactaaacgtactgngctgctacatctgttcttcttactcctcccgctatccttagtaacgttcgtaacgg

SEQ ID NO: 345069 - DNA, 570 bp, Homo sapiens
  misc_feature: GZ8MTXP01BBWEO.15.8.A08.1.454.CMB.2.raw
  modified_base (368)..(368): a, c, t, g, unknown or other
  misc_feature (368)..(368): n is a, c, g, or t
  modified_base (522)..(522): a, c, t, g, unknown or other
  misc_feature (522)..(522): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaagagccaccctctcctgcagggccagtcagagagttgccgccagtttacgcctggtaccaacagaaacctggccagcctcccaggctcctcatctatgctgcatccagttacgggacacgtggtactcccgagccaggttcaggtcggctagggtcgggtctggcacgagtacgttccacttctcaccatcagcacgcccgnacgtctagaagtatttgtctagtttacttactgtcaagtactaaataactaacgtaagtcggactacgttactaaccgtttccggacccgtaacggaacctaaaggtcggtaataactacgaaaacgtacgtggtgcgtgacctacacttcgtnttccttcttacttcccgttccctctactcgacgtcgttaacgtaacgg

SEQ ID NO: 345070 - DNA, 557 bp, Homo sapiens
  misc_feature: GZ8MTXP01BFQ3I.15.8.A08.1.454.CMB.2.raw
  modified_base (374)..(374): a, c, t, g, unknown or other
  misc_feature (374)..(374): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtctccgggggaaagacgccaccctctcctgcagggccagtcagagagttgccgccagtttagcctaggtaccaacagaaacctggccagcctccaggctctcatctatgctgcatccaagttagggaccacgtggtactccccagccaggttcaggtggcaggtgggtctggcacgagtacgtttccacttctacaccattccgacgccgacgccccgganacggttctaggaacgttatttgacttagtttattactgtcagctagtataactaagtcggactacggaacgggttcggaccgaacgggaccgaaggtaacgaaatacgaaacgtatgtagctgcacttgtcttgtcttcacttccttccgcctactctacgacgttactaacgttaagtaacg

SEQ ID NO: 345071 - DNA, 546 bp, Homo sapiens
  misc_feature: GZ8MTXP01DEW8V.15.8.A08.1.454.CMB.2.raw
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (467)..(467): a, c, t, g, unknown or other
  misc_feature (467)..(467): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgccaccctctcctgcagggccagtcagagagttgccgccagtttagcctaggtaaccaacaagaaacctggccagcctccgagcctctcatctatgctgcatccagtaggacactgtacncccagcagttcagtgcagtggtcngcacgagacttccactcncaacagtcagcacgcccntagtctaggaatattttgattagttatactgtanananaataataacgagtagactacttacgtacgttacgaccgacgaacgaaagtagataactaactaaacgtaacgtacgngtcgtcgactacttacgttacttcttcgttccttactcccttcccgtaacctactacgttacgtaacgttaacgtaacg

SEQ ID NO: 345072 - DNA, 615 bp, Homo sapiens
  misc_feature: GZ8MTXP01ENAVW.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgcctagtttacgcctggtaaccaacagaaacctggccacgcctcccgaggcctcctcatctatgctgctactcctagttacgggactacgtggtactccccgagcctaggttcaggtggctaggtgggtctcggacacgagtacgttccactctacaccataccgacgccgacgccccgacgtacgtcgtaggaaacgtttctttcggacttaagttttacttacgttgtaccaagtactaaataactaaacgacgtcggacttacgttacgttacgtttccgggaccgtaaacgggaacctaaaggtacgtataacgtaacaaacggtactggtagtctcgactacttagtcttcgttacttcttacttccctaccctaactactccgagtcgttaaccgtaacgg

SEQ ID NO: 345073 - DNA, 539 bp, Homo sapiens
  misc_feature: GZ8MTXP01ATRLC.15.8.A08.1.454.CMB.2.raw
  modified_base (169)..(169): a, c, t, g, unknown or other
  misc_feature (169)..(169): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (487)..(487): a, c, t, g, unknown or other
  misc_feature (487)..(487): n is a, c, g, or t
  modified_base (505)..(505): a, c, t, g, unknown or other
  misc_feature (505)..(505): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttacgcctggtaaccaacaagaaacctggccagccctcccaggcctcctnatctatgctgctatccagttagggacacgttggtactccccagcccgaggttcaggtggcaggtggtcnggcacagcttccactcncaccatcagccagccccgnagtctagaagtntttgctagtttatactgtacagcagtaataagtcgactcggccctaccggggacgttcggaccgaaacggggaccaaggtaggaaactacgaaacgtactggcgtcncgcacagttctgtcttcncttccttcccgctaatctgactcgttaacgaacg

SEQ ID NO: 345074 - DNA, 570 bp, Homo sapiens
  misc_feature: GZ8MTXP01B23C2.15.8.A08.1.454.CMB.2.raw
  modified_base (168)..(168): a, c, t, g, unknown or other
  misc_feature (168)..(168): n is a, c, g, or t
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaacagaaacctggccagcctccaggctcctcatctatgctgcatccattagggacactggtactccccagccaggttcagtggcaggtgggtctggcacagagttccactctcaccatcagcagcccgnagtcagaatctttgctagtttatactgtcagactaatataacaagtcggacctagttctacgttttacggaccccgtaagggaaccctaaaggtcggtaataacgtacgtaaaacgaaccgttgtacgggtctcggacctaacccttagttcctacgttccgttcttacttcccttccccgtcctaacgttcttacggtaacgttccgttaaaccggg

SEQ ID NO: 345075 - DNA, 546 bp, Homo sapiens
  misc_feature: GZ8MTXP01EXZKS.15.8.A08.1.454.CMB.2.raw
  modified_base (168)..(168): a, c, t, g, unknown or other
  misc_feature (168)..(168): n is a, c, g, or t
  modified_base (356)..(356): a, c, t, g, unknown or other
  misc_feature (356)..(356): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctctcatctatgctgcatccagttacggacactggtactccccagccaggttcaggtgcaggtgggtctggcacgagtagttcccactctcaccatcagcacgcccnagtctagatatttgctagtttatactgtcaagactaaatataaacgagtcgtactattcgtacgtttccggacccgtagggaaccaaaggtcggtaagtaatacgaaaacgtaacgtggtggctcgaccaaccttatcgttcttcttcttacttcccttcccgcctactcgttagtaacgttcgttaacg

SEQ ID NO: 345076 - DNA, 503 bp, Homo sapiens
  misc_feature: GZ8MTXP01CJGTT.15.8.A08.1.454.CMB.2.raw
  modified_base (168)..(168): a, c, t, g, unknown or other
  misc_feature (168)..(168): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (492)..(492): a, c, t, g, unknown or other
  misc_feature (492)..(492): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtactccccagccaggttcagtggcagtggctggcacngacgttccactctcaccntcagcagcccgnagtctagaatntttgctagtttatactgtcagacaatataacaagtcgactattcgactttcggacccaagggaccaaagtcggataactacgaaacgtactgtggctgcacagtctgttcttcacttcctcccgcatcncgtcgctaacg

SEQ ID NO: 345077 - DNA, 573 bp, Homo sapiens
  misc_feature: GZ8MTXP01AB22P.15.8.A08.1.454.CMB.2.raw
  modified_base (169)..(169): a, c, t, g, unknown or other
  misc_feature (169)..(169): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaancgccaccctctcctgcagggccagtcagagagttgccgcctagtttacgcctggtaaccaacgagaaaccctggcccagccctcccaggcctcctcatctatcgctgcatccaagttacgggactacgtggtactcccagtccgtaggttcagtggcgtaggtggtctggcacgtagacgttcccactctcaaccntacagcncgtcccgntacgtctagtaacttnttgacttagttatactgtacagactaataataacgtagtacgtactacttacgtacgttaccggtaccgaacggaacgtaagtagtagtactaacgtaacgtacgtcgtgtcgtcgctacttacgtctcttcgttcttctcctcccgtcctctacgttacgtaacgttaacgtaacg

SEQ ID NO: 345078 - DNA, 719 bp, Homo sapiens
  misc_feature: GZ8MTXP01BD6QW.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttacgcctggtaccaacagaaacctggccagcctccaggctcctcatctatgctgcatccagttaggactacgtggtactccccagcccgtaaggtttccaaggttcgggcgtaagggtttgggggttcctgggacccaacgaacggtacgtttccccaaccttcctaccaacccctaatcccaaggccctaacggcccccgccaagggttcctagggaaaacgttttcgttttagtactttaagtttagttacgttacgtactaacgtactaaattaactaaacgtaacggtacggtaccttaacgtttaccggttaaccggttttacccgggacccggtaaacgggtaaacccgtaaaggtacgggtaaacgttaacgtaaccgtaaaccggtaacgtcggtacggtcgtacgttacctaccttacgttccgttacgtttccgtttccttaccttccccgttaccccgaacccgtacgttaccgttacgtaacgttaacgttaacg

SEQ ID NO: 345079 - DNA, 619 bp, Homo sapiens
  misc_feature: GZ8MTXP01DA640.15.8.A08.1.454.CMB.2.raw
  modified_base (357)..(357): a, c, t, g, unknown or other
  misc_feature (357)..(357): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagcccaccctctcctgcagggccagtcagagagttgccgccagtttagcctggtaccaacagaaacctggccagcctcccaggcctcctcatctatgctgcatccagttagggacagtgactcccagccaggttcagtggcaggtggctggcacagacgttccactctcaccatcagccacgcccganagtctagtatatttgacttagtttatactgtacagactaaataactaacgtaagtcggtacctacgtttaccgtaaccgttttcccggggaacccgtaacgggggtaaaccctaaaggtcggtaaacttaaacgtaaccgaaaacgtaaccgtgggtacggtcgttacgaccctaccgttaattccgttcgttacctttccttaacttccccgtttacccgtcctaacttccgttagtaaccggttaaccgtttaaaccggg

SEQ ID NO: 345080 - DNA, 575 bp, Homo sapiens
  misc_feature: GZ8MTXP01EP077.15.8.A08.1.454.CMB.2.raw
  modified_base (170)..(170): a, c, t, g, unknown or other
  misc_feature (170)..(170): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctcctgcagggccagtcagagagttcgccgcctagtttacgcctaggtaaccaacagaaacctggccagcctccagctctcatctatgctgcatccagttaggacacgtggtactcccgagcctagttcagtggacaggtggtctggcagagtacgttccactcncacntacagcacgcccnagtctagtattntttgcttagttatactgtacagactaatacaacgagtcgacttacgttacgtacgtttccggaccccgtaagggaaaccctaaaggtggtaaacttaacgtaacgtaaacggtaactcggtacggcttcgacctaccttattcgttacgttccttcttacttcccttcccgaactagtcttaggtaacgttcgttaacggg

SEQ ID NO: 345081 - DNA, 572 bp, Homo sapiens
  misc_feature: GZ8MTXP01EUWRU.15.8.A08.1.454.CMB.2.raw
  modified_base (169)..(169): a, c, t, g, unknown or other
  misc_feature (169)..(169): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (546)..(546): a, c, t, g, unknown or other
  misc_feature (546)..(546): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttacgcctggtaaccaacaagaaacctggcccacgccctcccaggcctcctcatctatgctgcatccagttaggacacgtggtactcccagccgtaggttcaggtggcgtaggtgggtcctggcaacgtagtacgtttcccactctacacctatacagcacgcccgnacgtctaggaattntttgacttagtttatactgtacagactaatataacgagtcgacctattacgtacgtttaccggaccgaacgggaacctaaagtggtaattaacgtacgtaaacgacgtgcggtctcgacacttagttctacgttcttcaccttccgttcccnctacttcgacgtaacgttcgtaacgg

SEQ ID NO: 345082 - DNA, 585 bp, Homo sapiens
  misc_feature: GZ8MTXP01B3SCE.15.8.A08.1.454.CMB.2.raw
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccaccctctcctgcagggccagtcagagagttgccgccagtttagcctggtaccaacagaaacctggccagcctccaggctcctcatctatgctgcatccagttagggacatggtactcccagccaggttcagtggcaggtgggtctggctacagtacgttccactctcaaccatacagcacgcccgnagtcagaaatctttgctagttatacttgtacagtactaaataactaaacgtaaacgtcggtacctactttcgtaaccgttttccgggaccctaacggggaaaccctaaaggtacggaattaacgtaaccgtaaaacgtaactggtcggtaactcgacctaccttagtcctgttcttccacttcccgttccccgcttactcccttaggaaccgttcgttaaaccgg

SEQ ID NO: 345083 - DNA, 579 bp, Homo sapiens
  misc_feature: GZ8MTXP01COT83.15.8.A08.1.454.CMB.2.raw
  modified_base (169)..(169): a, c, t, g, unknown or other
  misc_feature (169)..(169): n is a, c, g, or t
  modified_base (383)..(383): a, c, t, g, unknown or other
  misc_feature (383)..(383): n is a, c, g, or t
  modified_base (511)..(511): a, c, t, g, unknown or other
  misc_feature (511)..(511): n is a, c, g, or t
  modified_base (547)..(547): a, c, t, g, unknown or other
  misc_feature (547)..(547): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgcctagtttagcctaggtaccaacagaaacctggccacgccctccaggcctcctcatctatgctgcatccagttaggacactggtactcccagccaggttcagtggctaggtggtctggctacgagtacgttccactctcgaccatcacgctacgcccgagtagtctagaagttntttgacgttagtttatactgtacagtactaatacgtaacagtcgtctactttcggtacgtttccggaccgaggaaccctaaaggtcgtaatacgtaacgtaaacgtactggtcgtctcgaccaccttnttaccgtgttacccgttcacctttccctccccggtntaacgttccgttagtaacgaacgtttaacggg

SEQ ID NO: 345084 - DNA, 668 bp, Homo sapiens
  misc_feature: GZ8MTXP01ER01O.15.8.A08.1.454.CMB.2.raw
  modified_base (170)..(170): a, c, t, g, unknown or other
  misc_feature (170)..(170): n is a, c, g, or t
  modified_base (333)..(333): a, c, t, g, unknown or other
  misc_feature (333)..(333): n is a, c, g, or t
  modified_base (405)..(405): a, c, t, g, unknown or other
  misc_feature (405)..(405): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctcctgcagggccagtcagagtagttcgccgcctagtttacgccgtaggtaaccaaacgacgaaacctgggaccacgccctacccgaggcctcctcatctatcgctgcatccagttacggacacgtgtactcccgagccgtaggtcaggtcgngtaggtcgggtctggccagagtcttccactctacacatcacgtcacggccccatacgtctagtaaacgtttnttacgtacgttagtttatacgtcgtactacgactaataacgtaacgtacgtacgtactacttaccggtaccggttaccggaaccgtaacggtaaaccgtaaaggtacggtaacttaacgtaacgtaaaccgtacgtacggtcggtccgtaccgttacctaaccgttacgttaccgttaccgtttacccttaccttaccgtttaaccccgttccccgtaaccgttaaccgttaccgttacggtaaccggtttaacggtaaccgg

SEQ ID NO: 345085 - DNA, 598 bp, Homo sapiens
  misc_feature: GZ8MTXP01D3O67.15.8.A08.1.454.CMB.2.raw
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagcgcccaccctctcctgcaggggccagtcagagagttcgccgcctagtttagcctaggtaaccaacagaaacctggccagcctcccagcctcctcatctatgctgcatccaagttacgggactacgtggtactccccgagccgtaggttcaggtggcagggtgggtctggcacagtagttccactctcaccatcagccacgcccgntagtctagaaagtntttnacttagtttatactgtacaagtactaaataacgtaaanaacggtcgtacctatttaccggtaacgtttccgggaccccgaaggggtaaacccaaaaggttcggaaattaactacgaaaacgtaacgtgtcggctcgaccaaccttagtccttcgttccttcttacttcccttcccgcctacgtcttacggaacgttccgttaagg

SEQ ID NO: 345086 - DNA, 641 bp, Homo sapiens
  misc_feature: GZ8MTXP01D8NLE.15.8.A08.1.454.CMB.2.raw
  modified_base (217)..(217): a, c, t, g, unknown or other
  misc_feature (217)..(217): n is a, c, g, or t
  modified_base (267)..(267): a, c, t, g, unknown or other
  misc_feature (267)..(267): n is a, c, g, or t
  modified_base (343)..(343): a, c, t, g, unknown or other
  misc_feature (343)..(343): n is a, c, g, or t
tcagtctacgtagccacgaccggtgctcgatttagcatactctacaggggtccctgagactctcctgtgccgcctctggagcagagtctgaattcaccttcatgcactttgccatgagctgggtccgccaggcgtccggggaaggggctggagtgcgtcgcatgtaataaactaaaagtggagacatcacactctacgcagactccgtggaaggccncttcaccatctcagagacaactccaaagaaccacgctcgtccctggagangaaacagcctagagagccgaggacacggcctattttatactgtgacgaaagagttaggttacgggggattaattancgaagtaactacttatttgactccgtagggcaaggggctcccgtggtccacccgtctcctacacgcctaccgacgaacgggcccacgttccggtccccttccccgtcggaccctacccctccctaccgaacgtacggccctaacccgtcggtcgggggaccaccgacggtcccggcccgtcggggtccgtcggtcccgtggtaaccgtaaacggttaccttacccgttccgaccgttaacggttacggttccgttagggaaccgggtcggggccgttcggacgaacggtccgcgtaag

SEQ ID NO: 345087 - DNA, 563 bp, Homo sapiens
  misc_feature: GZ8MTXP01BDPAV.15.8.A08.1.454.CMB.2.raw
  modified_base (168)..(168): a, c, t, g, unknown or other
  misc_feature (168)..(168): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctctcatctatgctgcatccagttacgggacacgtggtactccccgagccgaggttcagtcggctagggtgggtctggcaacgagtacgttccactctacaccatcagcacgcccgnagtctagaagtatttgacttagtttatacgtgtcacgactaaatactaaacgtagtcggaccttattccgtacgttccgggccaagggaaccaaggtgaattaacgacctaaacgtacgtggtcggctcgaccaccttattcgtcttccttcttacctccttccccgaacttacgtccttgaacgttccgttaacgg

SEQ ID NO: 345088 - DNA, 745 bp, Homo sapiens
  misc_feature: GZ8MTXP01DLMF0.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttcgccgcctagtttacgcctaggtaaccaacacgaaacctggccacgccctcccaggcctcctcatctatgctgcactccaagttacgggactacgtcggtactccccgacgcccgtaggttccgaggtcggacgtagggttcggtcgtggaccaacgacggtacgtttacccaccttcctaccaccctataccgacgccgaccgccccgactacggtacctaagggtaaagtttacttttacggtacctttaaggtttttaacttacgttacggttaacaacgttaaacctaaagttaaacgtaaacgtaacggttccggtaccttaacgtttacccggttaacccggttttacccggggaaccccgtaaacggggtaaaccccgtaaagggttcggaaactttaacgtaaaccgtaaaacggtacgttcgggtacggtcgttaccgaccctaaaccgttcgttaccttacgtttaccctttcgttaccctttccccgttacccgtaacttacgtccgttacgtaaccgttccgttaaacggg

SEQ ID NO: 345089 - DNA, 759 bp, Homo sapiens
  misc_feature: GZ8MTXP01BZ7Z9.15.8.A08.1.454.CMB.2.raw
  modified_base (170)..(170): a, c, t, g, unknown or other
  misc_feature (170)..(170): n is a, c, g, or t
  modified_base (261)..(261): a, c, t, g, unknown or other
  misc_feature (261)..(261): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctcctgcagggccagtcagagagttgccgcctagtttacgcctggtaaccaacagaaacctggccagcctccagcctcctnatctatgctgcatccagttacgggactacgtggtactccccagccgtaggttacaggtcggacgtagggttcgggtctgggacaacgagtacgtttcccaccttctaccgaaccctattacccaacgggtcccaacgggccccccgtagtaacgggtttccgttaagggtaaaacgtttacgtttttacggtaccgtttaaggtttttaactttaccgttacgttacccgtaaggtacctaaattaaacgttaaaccgtaaaggttacgggtacccttaactttaccggttaacccggttttacccggggaccccgtaaacgggggtaaaccctaaagggttacggtaacgttaaactaacccgtaaaacggtaacgttcgggtaacgggtccttacggacctaaccgttacgttaccttcgttcccgtttacttacccgttcccgtttccccgtaaccgttaactcccgttaggtaaccgttaaccgtttaaaccgg

SEQ ID NO: 345090 - DNA, 508 bp, Homo sapiens
  misc_feature: GZ8MTXP01DOUL5.15.8.A08.1.454.CMB.2.raw
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaaccaacagaaacctggccagcctccaggctcctcatctatgctgcatccattaggacactggtatcccagccaggttcagtggcaggtggtctggcacgagacgttccactctcaccatcagcagcccgnagtctagaagtatttgctagtttattactgtacagacaataataacaagtgactattcgtactttcggacccaagggaaccaaagtggataatacaaacgtactgtggctgcaccatctgttcttcactccttcccgctatcttgcgttcgtaacg

SEQ ID NO: 345091 - DNA, 585 bp, Homo sapiens
  misc_feature: GZ8MTXP01C51JP.15.8.A08.1.454.CMB.2.raw
  modified_base (168)..(168): a, c, t, g, unknown or other
  misc_feature (168)..(168): n is a, c, g, or t
  modified_base (388)..(388): a, c, t, g, unknown or other
  misc_feature (388)..(388): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaanagccaccctctcctgcagggccagtcagagagttcgccgcctagtttagcctggtaccaacagaaacctggccagcctccaggcctcctcatctatcgctgctatcctaagttacgggactacgttggtactccccgagccctagggtttcaggtggctagggttcggggtctggacaacgtaggtacgttccccactctcaccatccagcacgccccgnacgtctagtaagtattttcgacttagtttatactgtacacgtactaaatactaacgagtcgacctacttcgtacgtttccgggaccgaagggaacctaaaggtgaattaactacgtaaacgaacgtggtcggctgacctaccagttcttgttccttcttacgttccttacccgctatcgttagtaacgttctaacgg

SEQ ID NO: 345092 - DNA, 727 bp, Homo sapiens
  misc_feature: GZ8MTXP01D46R5.15.8.A08.1.454.CMB.2.raw
  modified_base (169)..(169): a, c, t, g, unknown or other
  misc_feature (169)..(169): n is a, c, g, or t
  modified_base (234)..(234): a, c, t, g, unknown or other
  misc_feature (234)..(234): n is a, c, g, or t
  modified_base (263)..(263): a, c, t, g, unknown or other
  misc_feature (263)..(263): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgcccaccctctcctgcgagggccagtcagagagttcgccgctagtttacgcctaggtaccaanagaaacctggccagcctccgagcctcctnatctatgctgctatccaagttacggacacgtggtactcccgagcgtaggttcaggtcggcgtagggttcggtctacggaccaacgaggtacgtttaccccaccttctaccaaccctaagtaccgaacggccgaaccggcccccgataacggtccgtaaggtaaagtttacgttttgaacctttaaggttttaacttcgtacggtactaaacgtaactaaagttaaactaaacgtaaacggttcggtaaccttaacgtttacccgggttaaacggtttccccggggaaacccgtaaacggggaaacccgtaaaaggttggtaaacttaaacgtaaaccgaaacggtacgtaggtcgggtaacctcggaccctaacccgttagtttccgttcgttcccttacttacccggtttcccctacccggtaacttaactcccgttaggtaacccgttaacggttaacccgg

SEQ ID NO: 345093 - DNA, 680 bp, Homo sapiens
  misc_feature: GZ8MTXP01AOM4B.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcaggccagtcagagagttgccgcctagtttacgcctaggtaaccaaacagaaacctggaccacgccctccaggcctcctcatctatgctgctatccaagttacgggactacgttaggtactccccgagtcccgtaggtttcaggtcggcgagggttcggggtctagggctaacgaggtacgtttccccaaccttctaccaaccctataccagccaacgcccccggataacgtcgtaggaaacgttattttcgactttaacggttttaacttacgttagttacaagtactaaaattaactaaacgtaacgtcggtacccttaagtttaccgtaccggtttaccgggaccccgtaagggaacctaaaggtcggaaattactaacgaaaacgtactcggtacggcttaccgactacccgttagtttccgttacgttccgtttcaccttcccgtttacccgaaccttagttcccgttaagaacgtttaacccgttaaggg

SEQ ID NO: 345094 - DNA, 695 bp, Homo sapiens
  misc_feature: GZ8MTXP01ET5CM.15.8.A08.1.454.CMB.2.raw
  modified_base (168)..(168): a, c, t, g, unknown or other
  misc_feature (168)..(168): n is a, c, g, or t
  modified_base (382)..(382): a, c, t, g, unknown or other
  misc_feature (382)..(382): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaangccaccctctcctgcagggccagtcagagagttgccgcctagtttacgcctggtaccaacagaaacctggccagcctccaggctcctcatctatgctgcatccagttaggactacgtggtactcccagcctaggttcaggttggcgtaggttcgggtctggccaacgagtacgttccccaccttctaccaaccactaccgagccgacgccccgntaacggttctagggtaaacgtttgttttacgtactttaaggttttacttaacgttggtaccaacgtactaaattaactaaacgtaaacggtcggtacccttacgtttaccgttaaccggttttacccggggaccccgtaaacggggtaaaccctaaacgggttaggtaaacttaaacgttaaccgaaaaccgtaaccgttggtaccgggctttacgaccctaaccgttacgttaccgtttcgttccgtttccttacctttccccgttccccggaacttaacgttccgttagtaaccgttaaccgttaaaccgg

SEQ ID NO: 345095 - DNA, 667 bp, Homo sapiens
  misc_feature: GZ8MTXP01B7TL8.15.8.A08.1.454.CMB.2.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctggtgtcgtaccgggggaaagacgccaccctctcctgcgagggccagtcagagagttgccgctagtttacgcctaggtaaccaacaagaaacctggaccacgccctcccgaggctcctcatctatgctgctatccaagttagggactacgtcggtaactccccgagcctaggttcaggtcggcgtagggtggtctggcaacgagtacgttcccactctacacatcgacgcacgccgntagtctagaaattntttgacttagtttactacgtgtacaagtcgtaaagtactaaagtcgtaaccgtcgggacccttaccgggggtaacggtttccgggaaaccggaaaacgggggttaacccaaaagggggttaaacgaaaacgtaaacccgtaaaacgggtaaaccgttggggtacgggccttaacggaacccttacccgtattccgttcgttacctttaccttaccggttccctttccccgacctaagtttcgacgttacgtcgttaaccggtaagg

SEQ ID NO: 345096 - DNA, 559 bp, Homo sapiens
  misc_feature: GZ8MTXP01C5YMY.15.8.A08.1.454.CMB.2.raw
  modified_base (332)..(332): a, c, t, g, unknown or other
  misc_feature (332)..(332): n is a, c, g, or t
tcagtctacgtagccacgaccggtgctcgatttagcatactctacagggtggctggagactgcgtcatcactacttctcttcctcctgctactctggctcccagataccactggagaagtagtgatgacgaagtctccagccaccctgtctgtgtctccgggggaaagagccaccctctcctgcagggccagtcagagagttgccgccagtttagcctggtaccaacagaacctggccagccctccaggcctcctcatctatgctgcatccagttagggacacgtggtactccccagcctaggttcaggtggcaggtgggtctggcacgagngttcacctcctcaccatccaacgcaacggccccgacacgtctaggtaagtattttgacttagttttacttacgtgtcaagactaaatataaacagtcgacctattcctacggtttccggaccgaagggaccaaagtgatatacaaagtactgtcggctgcactcttcgtcgtcttcgttcttcccgttccccgtactaacttcgtacgacgtccgttaacggtaacg

SEQ ID NO: 345097 - DNA, 716 bp, Homo sapiens
  misc_feature: GZ8MTXP01CN6PU.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggccggagactgcgtcatcactacttctcttcctcctgctactctggctcccagataccactggagaagtagtgatgacgcagtctccagccacctgtctgtgtcgtaccggggaaancgccaccctctcctgcagggccagtcagagagttcgccgcctagtttagcctaggtaaccaacaacgaaacctggccacgccctcccgaggtcctcctcatctatgctgcatccagttagggacacgtgtactcccgagcctaggttcaggtcggcgtaggtgggtctggacacgagtcgttacacccttctacaacctatccgaaacgccaaccggcccgtacgtaacgttacgtaggtaaacgtttagtttttcgacctttaagttttaacttaacgtcgttacgaacgtaactaaagttaactaaacgtaaggtcggtaaccttacgtttaacccgttaaccgggttttaccccgggaaccccggtaaacggggtaaacccgtaaaaacgggttagggaaacttaaacgtaaaccgtaaaacgtaaccgttggttaacggccgttaacggaacccttaaccgttaacgttcgttaaccgttcttccgttaacttccgttaaccccgactaacttcgtagttaccgtaaccgttaacggtaaccgg

SEQ ID NO: 345098 - DNA, 564 bp, Homo sapiens
  misc_feature: GZ8MTXP01CRDI6.15.8.A08.1.454.CMB.2.raw
  modified_base (354)..(354): a, c, t, g, unknown or other
  misc_feature (354)..(354): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttagcctggtaccaacagaaacctggccagcctccaggctcctcatctatgctgcatccagttaggacactggtactcccagccaggttcagtggcaggtggctggcacgagtcttccactctcaccatcagcagccccgntagtctagtaagtattttgactagtttatactgtacagtactaataataacagtcgactacttacgtacgtttccggacctaacgggacctaaagtacggtataacgtacgaaacgtacgtaggtcggctcggacctaccagttccgttcgttacctttcttactttccccgtaccctcctacttccgttacgtaacgttccgttaacgg

SEQ ID NO: 345099 - DNA, 592 bp, Homo sapiens
  misc_feature: GZ8MTXP01BITQ2.15.8.A08.1.454.CMB.2.raw
  modified_base (169)..(169): a, c, t, g, unknown or other
  misc_feature (169)..(169): n is a, c, g, or t
  modified_base (526)..(526): a, c, t, g, unknown or other
  misc_feature (526)..(526): n is a, c, g, or t
  modified_base (575)..(575): a, c, t, g, unknown or other
  misc_feature (575)..(575): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcgagggccagtcagagagttgcccgctagtttacgcctggtaaccaacagaaacctggcccacgccctccgaggcctcctcatctatcgctgctatccagttacgggactacgtggtactcccgagcctaggttcgaggttcggcgtagggttcggtcgtcggacacgtagtacgttaccactctacaccatccagccgacgccccgatacgtctagtaagtatttgacttagtttatactgtacagtactaaatataaacgagtcgacttacttacgtaccgtttcggacccgtaagggaacctaaggtgaactaactaccgaaacggtacttggcggtntacggacctaccttagtcttcttcttcacgttccctaccggctccggtnttacgaagttccgtaag

SEQ ID NO: 345100 - DNA, 749 bp, Homo sapiens
  misc_feature: GZ8MTXP01B6V4M.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttgccgctagtttagcctaggtaccaacagaaacctggccagccctccgaggtctcttatctatgctgcactccagttagggactacgtggtactccccgagccctaggtttcaggttggctagggttcgggggtactcgggaccaacgtaggtacgtttccaacccctttccacaaccctataccgaaacgcccgaacggccccgtacgtaacgggttccttaagggtaaacgtttacgtttttacgacgttttaaggttttaacttaccgtaggttaccaagtaacctaaattaacgtaaacgaaggttcgaccttaactttcccgttaaccggggtttcccggggaaccccgtaaacgggggtaaaccctaaagggttacggtaaacttaaacgttaaacccgaaaacgtaacgttcggtacggtacctcggtaaccttaaccttactttccgttaaggtttcccctttaccttaaccgtttcccctttaaccccgacttaacgtttcccgtagggttaaccgtcccgtttaaagggtaaccgg

SEQ ID NO: 345101 - DNA, 593 bp, Homo sapiens
  misc_feature: GZ8MTXP01EF6W1.15.8.A08.1.454.CMB.2.raw
  modified_base (375)..(375): a, c, t, g, unknown or other
  misc_feature (375)..(375): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaactggccagcctccaggctcctcatctatgctgcatccattagggacactggtactcccagccaggttcagtggcaggtggtctggcagagtagttcccactctcacccataccgagcacggccccgcacgtctagtaaagttnttttgcttagtttatacttgtcaagactaaataactaaacgaacgtggacctagttaccgtaccgtttaccgggacccgtaaggggaaccctaaaggtggaacttaactacgtaaaaccgtaacttggtggctacgctaacccgttagtaccttcgttaccgtttcttaaccttcccgtttccccgcctacttccgttagtaacgttccttaaaccgg

SEQ ID NO: 345102 - DNA, 561 bp, Homo sapiens
  misc_feature: GZ8MTXP01DYAZY.15.8.A08.1.454.CMB.2.raw
  modified_base (516)..(516): a, c, t, g, unknown or other
  misc_feature (516)..(516): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagcctccaggctcctcatctatgctgcataccagttagggacactggtatccccagccagggttcagtggctaggtggtctggcacgagacttccactctacaccatccagcacgccccgactaggtctaggaaagttcttttgacttagtttaactactgtctaagactaataataacgaacgtacggactacttactacgtttaccggtacccgacggaaccgaaagtaggtataatacgaaacgtaacgtacgtggaactcgcacacgtactnttcttcttactccttcccgtcctactcgttagtcgttcgtaacgg

SEQ ID NO: 345103 - DNA, 668 bp, Homo sapiens
  misc_feature: GZ8MTXP01EF8ZS.15.8.A08.1.454.CMB.2.raw
  modified_base (171)..(171): a, c, t, g, unknown or other
  misc_feature (171)..(171): n is a, c, g, or t
  modified_base (305)..(305): a, c, t, g, unknown or other
  misc_feature (305)..(305): n is a, c, g, or t
tcagtctacgtagccacgaccggtgctcgatttagcatactctacagggtggctggagactgcgtcatcactacttctcttcctcctgctactctggcctcccagataccactggagaagtagtgatgacgcagtctccagccaccctgtctgtgtcgtaccgggggaaancgcccaccctctccgtgcgagggccagtcagagtagttcgccgctagtttacgcctaggtaaccaacagaaacctggccacgccctccgagcctcctcatctatgctgcatccagttacggactacgtggtacncccgagccgtaggttcaggtggcgtaggttcggggtctggacacgtagtactttcccactctacacctatccacgccgaccgccccgatacggtacgtaggtaaacgtttctttagtactttaagtttacttacgttagtactaacgtaactaaataaacgtaaacgtaagtcgtaccttacttaccggtaaccggtttccggaacccgtaacgggaaacccgtaaaggtacggtaactaaacgtaaccgtaaaccgtaacgtggtacggtctacgttacctaaccgttcgttacgttcgttaccttcttacctttcccctacccgtaacctctacgttacggtaaccgttaaccgttaacgg

SEQ ID NO: 345104 - DNA, 532 bp, Homo sapiens
  misc_feature: GZ8MTXP01C5VUI.15.8.A08.1.454.CMB.2.raw
  modified_base (169)..(169): a, c, t, g, unknown or other
  misc_feature (169)..(169): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
  modified_base (517)..(517): a, c, t, g, unknown or other
  misc_feature (517)..(517): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtcgtaccgggggaaancgccaccctctcctgcagggccagtcagagagttcgcgctagtttagccgtagtaaccaacagaaacctcggccacgcctccaggctcctcatctatgctgcatccgagttaggacatggtactcccgagccgtaggttcaggtggctagggtcggtctggacacgagtcgttccacttcacacatacaggcacgcccgataggctaggaaattctttgactagttatactgtacaagtacaaatataaacagtcgactattcgtacgttcggaccaaggacaaagtgaatataacaaagactgaggctcgcaccttagtctnttcttcacttccctccnctactcgngtaacgaacgttaag

SEQ ID NO: 345105 - DNA, 736 bp, Homo sapiens
  misc_feature: GZ8MTXP01CPXO0.15.8.A08.1.454.CMB.2.raw
  modified_base (170)..(170): a, c, t, g, unknown or other
  misc_feature (170)..(170): n is a, c, g, or t
  modified_base (256)..(256): a, c, t, g, unknown or other
  misc_feature (256)..(256): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaancgccaccctctcctgcaggccagtcagagagttgccgcagtttagcctggtaccaacagaaacctggccagccctccaggctcctnatctatgctgcatccagttacgggactacgtggtaactccccgagtccaggtttcaggtcggactagggttgggggtctgggccaacgtagtacgtttccccaacttctaccaacccatacccaagcccaacggcccccgtacgtaacggttctaagggtaaacgtttgtttttcggtacttaaggttttacttacttagttaccaagtactaaattaaacttaaacgtaaacggttacggtaccttaactttaccggttaacccgtttttacccggggaaccccgtaaacggggtaaacccgtaaaaggttacgggtaaacgtttaaactaaaccgtaaaaccggtaaaccgttcgggtacgggtaaccttacggacccgtaacccgttaacgttaccgttacgtttcccgttccttacctttccccgttccccgtaacccttacgttccttacggtaacgttaacccgtttaaaccgg

SEQ ID NO: 345106 - DNA, 620 bp, Homo sapiens
  misc_feature: GZ8MTXP01CQ8VC.15.8.A08.1.454.CMB.2.raw
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (544)..(544): a, c, t, g, unknown or other
  misc_feature (544)..(544): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgcccaccctctcctgcagggccagtcagagagttgccgccagtttagcctaggtaccaacagaaacctggaccacgccctcccaggtctcctcatctatgctgcatccagttagggaccactggtactccccagccaggtcaggtcggctaggtgggtctggacacgagtacgtttccaccttctcaaccatcaacgccacgccccganacggtctaggaaagttntttgactagttttattactgtacagtacaaatataaacaagtcgtacctagttactaccgtttaccgggacctaacgggaaacctaaaggtacggtaattaaacgtaaccgtaaaacgtacgttagtcgggcttacggactaaccncttaccgttcgtttaccttcttaaccctttcccggtacccctccttacgtcttacggtcgttaacccgttaaccgg

SEQ ID NO: 345107 - DNA, 523 bp, Homo sapiens
  misc_feature: GZ8MTXP01B9OU7.15.8.A08.1.454.CMB.2.raw
  modified_base (167)..(167): a, c, t, g, unknown or other
  misc_feature (167)..(167): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaanagccaccctctcctgcagggccagtcagagagttgccgcagtttagcctggtaccaacagaaacctggccagcctccaggctcctnatctangctgcatccattagggacatggtactcccagccaggttcagtgcagtggtctggcacagagttccactctcaccatcagcacgcccganagtctgaaagtntttgctagttattactgtacagtacaatacaacaagtgacctattcgtacgtttcggcccgtaagggaaccaaagtcggaataactacgaaacgtaacgtgtggctcgcaccttatcttgttcttcattccttcccgctatcttacgtaacgttcgttaacgg

SEQ ID NO: 345108 - DNA, 766 bp, Homo sapiens
  misc_feature: GZ8MTXP01BX9A7.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaagacgccaccctctcctgcagggccagtcagagagttcgccgcctagtttagcctaggtaacccaaacgaacgaaacctgggacccacgcccctcccgaggcctcctcatctatgctgcatccgaagttacggactacgtggtactccccgagcccgtaggttcaaggtcggacgagggttcgggtctaggacctacgagtacgttcccacctctaccaacctataccacgccgtacggcccccgtagtacgttccgttaaggtaaacgtttattttacggtaacctttaaggtttttaacttacggttactaccggtaaagtaacctaaaattaaccgtaaaacgtaacgggttaccggtaaccctttaacctttacccggggttaaacccggttttacccggggaaacccccggtaaacgggggtaaaacccgtaaaagggttaccgggtaaacttaaaccggttaaccgaaaacgggtaaccgttcgggtacggtaaccttacggaccctaaaccggttcgtttaccgtcgttacccttccgttaccctttccccgtacccgtaacgttacgtacgttacgtaaccgttccgtaacg

SEQ ID NO: 345109 - DNA, 548 bp, Homo sapiens
  misc_feature: GZ8MTXP01B28O6.15.8.A08.1.454.CMB.2.raw
  modified_base (168)..(168): a, c, t, g, unknown or other
  misc_feature (168)..(168): n is a, c, g, or t
  modified_base (524)..(524): a, c, t, g, unknown or other
  misc_feature (524)..(524): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanacgccaccctctcctgcagggccagtcagagagttgccgcctagtttagcctggtaccaacagaaacctggccagcctccaggctcctcatctatgctgcatccaagttacgggacacgttggtactcccagcctaggttcaggtcggctaggttcgggtctggacacgagtacgtttcccactctcacccatccagccacgccccgatacgtctagaacgttatttgactagtttactacgtgtacagtacaatactaacgagtcgactattcgacgtttcggaccagggaccaagtcgatacacgtaacgacgtggtgctcgcacttatcgtgttcttcttacttccgtacccnctatcttacgtcgttcgttaacgg

SEQ ID NO: 345110 - DNA, 714 bp, Homo sapiens
  misc_feature: GZ8MTXP01CJJCP.15.8.A08.1.454.CMB.2.raw
  modified_base (426)..(426): a, c, t, g, unknown or other
  misc_feature (426)..(426): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgccaccctctcctgcgagggccagtcagagagttgccgctagtttacgcctaggtaccaacaagaaacctggccacgccctcccaggctcctcatctatgctgcatccaagttacgggactacgttggtactccccgaaggccctagggtttcaggtcggaccgagggtttcgggtctaggaccacgagtacgttcccactctacaccgtataaccgacgccgtacgccccggatacggtactaggtaaagttnttttcgattaagtttatacgtgtacaacgtaactaaataacgtaaacgaagttcggaccttacgtttaccggtaccgtttaccgggaccccgaaagggtaaacccgtaaaggtcggtaattaacgtaaacccgaaaacggttaaccgtggtcgggtaaccgtaacgacccgttaaaccgttacgtttcccttacggtttcccgtttaccgttaaccccgtttcccgtttacccccccgcgttaaacttcccggttaaagggtaaccgttaacccggtttaaaccgggg

SEQ ID NO: 345111 - DNA, 662 bp, Homo sapiens
  misc_feature: GZ8MTXP01B02XS.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttcgccgcctagtttacgcctaggtaaccaacacgaaacctggcccacgccctcccaggcctcctcatctatgctgctataccagttacgggactacgtggtaactcccgaagtccgtaggttcaggtcggacgtagggtcggtctggacacgagtacgttcccactctaccacatacacgcacgcccgatacgtctagtaaagttgttttcgacttaagtttactacgtcgtactaacgtactaaataacgttaaacgaagtcggtaccttaacgtttaccggtaaccggtttacccgggacccgttaaacgggaaaccctaaaggtcggtaaacttaaacgttaaccgaaaccgtaagtcgggtacggtctaccgttctaccgttaacgttccgtcttaccgttacttaccgttcccttcccccgaactacgtcgttacgtaacgttcgttaaaccggg

SEQ ID NO: 345112 - DNA, 519 bp, Homo sapiens
  misc_feature: GZ8MTXP01CJ3EY.15.8.A08.1.454.CMB.2.raw
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattaggacactggtatcccagccaggttcagtggcagtgggcnggcacagagttccactncaccatcagcagcccgnagtctggaaanattttgcagttattactgtnagacaataataacaagtagactactactacttcgtaccgacggaacgaaagtagataatactaaacgaaacgtagtggtcgtcgcaccacgtctcgttcgttcttactccttcccgtcctactcttcgtaacgcgtaacg

SEQ ID NO: 345113 - DNA, 726 bp, Homo sapiens
  misc_feature: GZ8MTXP01CA5WD.15.8.A08.1.454.CMB.2.raw
  modified_base (444)..(444): a, c, t, g, unknown or other
  misc_feature (444)..(444): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgcccaccctctcctgcgagggccagtcagagagttgccgcctagtttacgcctggtaaccaacgaacgaaacctgggcccaacggccctccgaggtcctcctacatctatcgctgactactccaagttacgggactacgtggtactccccgagtccctagggttcaacggtggactagggtcggtctggacacgtagtacgtttacccactctccgaaccagtaccgaagccaacgggcccccgtacgtaaggttcctaagggtaaacgtttntttttacggtaccttaaggttttaacttaacgttacggttacaaacgtaacctaaataacgtaaacgtaacgtcggtacctaacgtttaccggtaccgtttaccggacccgtaacgggtaaaccgtaaaggttacgaagttaacgtaaacgtaaaccgtaaccgtggtcggtaactcggttacctaaacccttgttaaccgtcgtttacccttcgttaaccgtttccccgttaaccccgtcctaacgttccgttaacggtaacgttaacccgttaaaccggg

SEQ ID NO: 345114 - DNA, 845 bp, Homo sapiens
  misc_feature: GZ8MTXP01DQM5L.15.8.A08.1.454.CMB.2.raw
  modified_base (169)..(169): a, c, t, g, unknown or other
  misc_feature (169)..(169): n is a, c, g, or t
  modified_base (812)..(812): a, c, t, g, unknown or other
  misc_feature (812)..(812): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgcctagtttacgcctaggtaaccaaacgaacgaaacctcgggacccacgccctacccgaggcctcctcatctatcgctgctactcctagttacgggaccacgttggtaacctccccgaagtcccgtagggtttccaaggttcgggacgtacgggtttcgggggtaccttgggacccaaacgtacggtacgtttaccccccaaccttccttacccgaaccctaacgttacccgaacggcccgaaaccggccccccgtaagtaacggtttaccgtaaaggttaaacgtttacgttttttacggaccgtttaaaggttttttaacttaccgttacggttaaccaaaggttaaccttaaaatttaaacgaaaaccggtaaacgggttccggtaaacctttaacccggtttaccgtttaaaccccggggtttttacccggggaacccccgggttaaaacgggggaaacccttaaaaaggggttcggtaaacgtttaaaaccctaaaccgtaaaaaccgggttacgttgggttaccgggtaacttacgggaccctaacgttaactttaccggttcgtttaccttcttaacctttcccggttacccccgtntactccgttacggaaccgttaacgttaaccggg

SEQ ID NO: 345115 - DNA, 641 bp, Homo sapiens
  misc_feature: GZ8MTXP01BJAMG.15.8.A08.1.454.CMB.2.raw
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttacgcctggtaccaacagaaacctggccacgcctccaggctcctcatcatgctgcatccagttacgggactactggtactcccgagccgtaggttcagtggcaggtggtctggacacgagtacgttccactctcaccgataccagcacgccccganacgtctagaagttnttttcggacttagttttataccgttgtcaacgtactaaattacaaacgtaaggtcgtaccttagttccgttaccgtttaccgggacccgtaaggggaaaccctaaaggtgtaacttaaccgtaacgaaaacgtaccgttgggtcggtaaccttacggaccctaaaccttacgttctttcggttcctttaaccttacgtttccccgtttacccccaacttacgttacgttacggtaacgttaaccgtttaaacccggg

SEQ ID NO: 345116 - DNA, 586 bp, Homo sapiens
  misc_feature: GZ8MTXP01A3BC6.15.8.A08.1.454.CMB.2.raw
  modified_base (214)..(214): a, c, t, g, unknown or other
  misc_feature (214)..(214): n is a, c, g, or t
  modified_base (331)..(331): a, c, t, g, unknown or other
  misc_feature (331)..(331): n is a, c, g, or t
tcagtctacgtagccacgaccggtgctcgatttagcatactctacaggggtccctgagactctcctgtgccgcctctggagcagagtctgaattcaccttcatgcactttgccatgagctgggtccgccaggctccggggaaggggctggagtgcgtcgcatgtaataactaaaagtggagacatcacactctacgcagactccgtgaaggccncttcaccatctccagagacaactccaagaacacgctgtccctggagatgaacagcctgagagccgaggacacggcctatttatactgtgacgaaagataggttcggggattaattancgagaacttacttatttgactccgtaggggccaagggacgcccgtgggtccaccgtctcctcacgcctccaccgaacgggcccagtccggtcccttccccgcggcccacccctcctaccgaacgcggccaccgtcgtcgggggccaccgacggccggtcccgtgggcctcgccgtgggtccaaacgggttccttaccgttcccgtacgtaacggttacgcgttggaacggccgggcgtgggcgaacggcgcgaag

SEQ ID NO: 345117 - DNA, 648 bp, Homo sapiens
  misc_feature: GZ8MTXP01EY0YD.15.8.A08.1.454.CMB.2.raw
  modified_base (170)..(170): a, c, t, g, unknown or other
  misc_feature (170)..(170): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctcctgcgagggccagtcagagagttcgccgcctagtttacgccgtaggtaaccaacgaacgaaacctggaccacgccctcccgagtcctcctacatctatcgcttgctatcctaagttacgggacacgtcggactcccagcctaggttcaggtgcgtaggtggtcnggcacgtgtacgttcccacttcacaccntacgancgaccgccgnacgtctagtattatttcgnttacgtttatactacgatacgactaataactaacgagtacggtactacttaccggtacgtttacccgggaaccgtaacgggaacctaacggtaggtaactaacgttaacaaacggtacgttccggtagggaaccgttcgacctaaacccgtttcgttaccgttcttacccgttccttacccgttccccgttacccgtaacgttacgttcggttaacggtaaccgttaacggttaacgg

SEQ ID NO: 345118 - DNA, 831 bp, Homo sapiens
  misc_feature: GZ8MTXP01DAWFT.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgcccaccctctcctgccgagggccagtcagagtagttcgccgtacctagttttacgcccgttagggtaaacccaaacgaacgtaaacccgtcgggacccaacggtccccttacccgaggtccctccctactaactccgtattcgctacggactactacctaagttacggggacctacgttcggtaacctaccccgagtaccgtaaggggttaccaaggtcgggaccgtagggttcgggtcccgtagggaccaacgtaaggtaccgttttacccccaaccctttctacccaaaccctacgttaaacccgaaccgggtcccgaaacccgggcccccgttaacgtaacggttcccgttaagggaaaaggtttttacttttaccgttaccgtttaaggtttttaaccttaccggttaggtactaaacggtaacttaaactaaagtaaacctagggtaccgtaccttaactttaccggttacgtttcccggggaaaccgaacgggtaaaccgtaaaggtagaacttaaactaaaccgtaaacgtaccgttagggtcgtccggtaacacctaaccgttacgtttacttacgtttacccgtttcgttaaccctttcccggtacccccgttaatccgtaccgttaggtaacgttaacgttaaccggg

SEQ ID NO: 345119 - DNA, 671 bp, Homo sapiens
  misc_feature: GZ8MTXP01EKOE5.15.8.A08.1.454.CMB.2.raw
  modified_base (170)..(170): a, c, t, g, unknown or other
  misc_feature (170)..(170): n is a, c, g, or t
  modified_base (434)..(434): a, c, t, g, unknown or other
  misc_feature (434)..(434): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctcctgcagggccagtcagagagttcgccgcctagtttacgcctaggtaaccaaacaacgaaacctggacccacgtccctcccgaggcctcctcatctatgctgactatacctagttacgggactacgtggtacctcccgagccgtaggttcaggttggcctagggttcgggtcgtaggaccacaggtactttaccccaccttcaccaccataccaacgcacgccccgatacgtctaaggtagttattttacgntttaagtttacgtactgtacaagtactaaataactaagagtcgtactacttacgtacgtttccggaccgtaagggaaacctaaggtgtaataaacgtaacgtaaaccgtactggttcggccttacgacctaaaccttacgtttaccgtccgttttacccgttacggttaacccgtttcccccgtttaaccccgtaaccgttacgttaccggttaacgtaaccggttaacgttaacgg

SEQ ID NO: 345120 - DNA, 564 bp, Homo sapiens
  misc_feature: GZ8MTXP01D1ADI.15.8.A08.1.454.CMB.2.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (493)..(493): a, c, t, g, unknown or other
  misc_feature (493)..(493): n is a, c, g, or t
  modified_base (537)..(537): a, c, t, g, unknown or other
  misc_feature (537)..(537): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccacccctctccctgcagggccagtcagagagttgccgccagtttagcctggtaccaacagaaacctggccagcctcccaggcctctcatctatgctgcatccagttagggacatggtactccccagcctaggttcaggtggcaggtgggtctggcacagagttcccactctcaccatcancacgcccnagtcagtagtntttgctagtttattactgtacaagtactaaataactaacaagtcggacctacgttccgttaccgtttcgggaccccaacggggaacctaaaggtggtaattaactacgaaacgtactaggnggcttcgacctaccattcttcgttcctttcacctttccgtcccncctatccttagtaacgttcgttaacgg

SEQ ID NO: 345121 - DNA, 671 bp, Homo sapiens
  misc_feature: GZ8MTXP01ETDND.15.8.A08.1.454.CMB.2.raw
  modified_base (169)..(169): a, c, t, g, unknown or other
  misc_feature (169)..(169): n is a, c, g, or t
  modified_base (263)..(263): a, c, t, g, unknown or other
  misc_feature (263)..(263): n is a, c, g, or t
  modified_base (330)..(330): a, c, t, g, unknown or other
  misc_feature (330)..(330): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttagcctggtaccaacagaaacctggccagccctccagctcctcatctangctgcatccagttacgggactacgtggtactccccgagccgtaggttcaggtggctagggtgggtcnggacacgagtcgttcccacttctacacctataccagtccacggtccccgagtacgttacgtaggtaaagtttacgttttgtacctttaggttttaacttacgtaggttactaacgtactaaattaactaaacgtagttacggtaccttaacgtttaccgtaccggttttacccgggaccccgtaacggggtaaacccgtaaaaggtcggtaaacttaacgtaaccgtaaaaccggtaacgttgggtcggtaacttcggacctaaccttacgttccttacgtttccttccttaccgttcccttaccccgtcttacgtcgttacgtaacgttccgttaaccgg

SEQ ID NO: 345122 - DNA, 671 bp, Homo sapiens
  misc_feature: GZ8MTXP01E1BQN.15.8.A08.1.454.CMB.2.raw
  modified_base (168)..(168): a, c, t, g, unknown or other
  misc_feature (168)..(168): n is a, c, g, or t
  modified_base (642)..(642): a, c, t, g, unknown or other
  misc_feature (642)..(642): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcgagggccagtcagagagttcgccgcctagtttacgcctaggtaaccaacgaagaacctggaccagccctccgaggtcctcctcactctatcgctcgcactccaaggttagggacctacgttggtactccccgagccgtaggttcaggtgggcagggttcggtcctggccaacgtaggtactttccccactctacaaccgtactacacgtccgacggccccatacgttcgtaagggtaaactttgttttcgtacttaagtttttaacttacgttacgtacgtaacgtaactaaattaaaccgtaaagtaaacgggttccggtaaccttaactttaccgtaccggttttaacccgggaccccggtaaaggggaacctaaaaggtcggtaaataagtaacgaaacgtacttgggcgtcgtgacctacccttatcgttcttccttcttaccttcccttacccnctacgtcttaggtaacgttcgttaacggg

SEQ ID NO: 345123 - DNA, 670 bp, Homo sapiens
  misc_feature: GZ8MTXP01EMX7H.15.8.A08.1.454.CMB.2.raw
  modified_base (168)..(168): a, c, t, g, unknown or other
  misc_feature (168)..(168): n is a, c, g, or t
  modified_base (263)..(263): a, c, t, g, unknown or other
  misc_feature (263)..(263): n is a, c, g, or t
  modified_base (364)..(364): a, c, t, g, unknown or other
  misc_feature (364)..(364): n is a, c, g, or t
  modified_base (386)..(386): a, c, t, g, unknown or other
  misc_feature (386)..(386): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctggtaccaacagaaacctggccagcctccaggctcctcatctatnctgcatccagttacgggactactggtactccccgagcccgtaggttcaggttggacgtaggttcgggtctggacacgtacgtagttcccacttctacaccncgtaccgagccacggtccccgngtacgtaccgtagtaaacgttcgttttcggacttaaggttttacttacgtcggttactaacggtactaaataactaacggtaaacgtcggtaccttaacgtttcccgtaacggttttacccgggaacccgtaaacggggaacctaaaggtaccggtaattaaacgtaaccgtaaacggtacgttacggtacgggtctacggccctaaacccttagttccggttcttaccgttccttacttcccggttacccgcgtacttcgttacgtcgttaacgttaaccggg

SEQ ID NO: 345124 - DNA, 640 bp, Homo sapiens
  misc_feature: GZ8MTXP01CL99H.15.8.A08.1.454.CMB.2.raw
  modified_base (169)..(169): a, c, t, g, unknown or other
  misc_feature (169)..(169): n is a, c, g, or t
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaancgccaccctctcctgcagggccagtcagagagttcgccgcctagtttacgcctaggtaaccaacaagaaacctcggaccacgccctcccgaggcctcctnatctatcgctgcatccaagttacggactacgtggtactcccgagcccgtaggttcagtggctaggtgggtctggcacgnggtattccccactctcaacccataccacgcaccggcccagtacgtctagtaaagttnttttcggacttagtttacttacgtgtacaagtactaaataacgtaaacaagtcggtactatttaccggtacgtttacccgggaccgtaacgggtaaacctaaaggtaggtattaacgtaacgaaaaccgtagtttcggacgggtctcggacctacccttatttaccgtctttccgttcttacccttcccgttaccccgtaactacgtcgttacgtaacgttaaccgtttaaacgg

SEQ ID NO: 345125 - DNA, 633 bp, Homo sapiens
  misc_feature: GZ8MTXP01AER1X.15.8.A08.1.454.CMB.2.raw
  modified_base (168)..(168): a, c, t, g, unknown or other
  misc_feature (168)..(168): n is a, c, g, or t
  modified_base (411)..(411): a, c, t, g, unknown or other
  misc_feature (411)..(411): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaanacgccaccctctcctgcagggccagtcagagagttgccgcctagtttagcctaggtaaccaacacgaaacctggacccacgccctcccgaggcctcctcatctatcgctgctactccaagttacgggactacgtggtactcccagcctaggttcaggtggcgaggttggtctaggcacgagtacgttcccactctaccgacctatccgaacgtccgacgccccgagtacgtcgtagtaagttntttcgacttagtttactacgtgtacaacgtactaaagtaactaaacgtagtcgtaccttacgttaccgtacgttccggacccgtaaggtaacctaaaggtcgtaataacgtaaccgtaaacgtacgtcggtcggtcctacggaccctaccgttactttccgttacttcctttccacgttcccttacccgcttctccggttagtaacgttaaccgttaacggg

SEQ ID NO: 345126 - DNA, 703 bp, Homo sapiens
  misc_feature: GZ8MTXP01DBKJ3.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttagcctggtaccaacagaaacctggccagcctccaggcctcctcatctatgctgcatccagttacgggactacgtggtactcccgagccgtaggttcaggtggcgtagggttgggtctggccaacgagtacgtttcccaccttctaccaaccataccagccgaacgtccccgagtacgtccgtaggtaaagttagttttcgtacttaaggtttacttacgtgtacagtacaaattaacgaaacgtaagtcggtaccttaactttccggttaacccgtttacccggggaaccccgtaaacggggtaaacccgtaaaagggttacgggtaaacttaaacgtaaaccgtaaaaaccggtaaaccgttgggttacgggaaccttcggaccctaacccgttacgttaccgttcgtttaccctttcgttacctttccccggttaccccgtaaccttaacgttccgttacggtaaccgttaaccgtttaaaccggg

SEQ ID NO: 345127 - DNA, 518 bp, Homo sapiens
  misc_feature: GZ8MTXP01EK6ZR.15.8.A08.1.454.CMB.2.raw
  modified_base (168)..(168): a, c, t, g, unknown or other
  misc_feature (168)..(168): n is a, c, g, or t
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgctagtttagcctggtaccaacagaaacctggccagcctccagctcctcatctatgctgcatcctagttaggacactggtactcccagtccaggttcaggtggctagggtggtctggcacgngtacgttccactctacaccatcagccacgcccganagtcgtagaagttatttgcttagtttatactgtacagtactaatataacagtcgactattccgtacgttcggaccacgggtaacaagtgatacacgaaagactgtggctgctaccntcgtnttccttcacttccctccgctncttgcgttgtaacg

SEQ ID NO: 345128 - DNA, 557 bp, Homo sapiens
  misc_feature: GZ8MTXP01E1E3N.15.8.A08.1.454.CMB.2.raw
  modified_base (168)..(168): a, c, t, g, unknown or other
  misc_feature (168)..(168): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccagttacgggacacgtggtactccccagcctaggttcagtggcagtggtctggcacgagagttcccactctcaaccntacagcacgcccganaggttctgaagtatttgctagtttatactgtcagacaatataacagtgactattcgtactttccggaccgtacgggaaccaaaggtcggtaataactacgaaacgtaacgtggtggcttcgacaaaccttgttcgttcgttccttcttaccttcccttaccccgtctacgttacgttacgtaaccgttcgtaacgg

SEQ ID NO: 345129 - DNA, 675 bp, Homo sapiens
  misc_feature: GZ8MTXP01CT0M9.15.8.A08.1.454.CMB.2.raw
  modified_base (613)..(613): a, c, t, g, unknown or other
  misc_feature (613)..(613): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaagacgccaccctctcctgcaggccagtcagagagttcgccgcctagtttacgccgtaggtaaccaacacgaaacctcggcccacgccctcccgaggtcctcctcatctatgctgcatccagttacggactcgtggtactcccgagtccgtaggtttcgaggtggccgtagggttcgggtcgtggcacgagtacgttccccacctctccaacccataaccgacgccgaccggtcccgacgtacgtctaaggtaacgttattttcgacttaacgttttacttacgtacggttacaacgtaactaaataaacgtaaacgacgtcgtacctactttaccggttaccgtttacccggacccgtaacgggtaaaccgaacggttaggaacttaacgtaaaccgtaaaaccgtacggttggtcgggtcttacgaccctaccgttagttccgttnttacccttccttaccttcccgttaccccgcttactaccgttacgaacgtttccgtaaaccgg

SEQ ID NO: 345130 - DNA, 698 bp, Homo sapiens
  misc_feature: GZ8MTXP01BKF2L.15.8.A08.1.454.CMB.2.raw
  modified_base (418)..(418): a, c, t, g, unknown or other
  misc_feature (418)..(418): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgccaccctctcctgcgagggccagtcagagagttcgccgcctagtttacgcctaggtaaccaaacgaacgaaacctgggcccacgccctcccgacggtcctccgtcatctatgctgctatccagttacggactacgtggtactcccgagccgtaggttcaggtggcgtaggttcgggtctggacacgtagtacgttccaccgtctacaaccataccgagccacgcccgatacgtctagtaacgttntttcgacttacgtttatacgtagtacagtactaaatactaacgtacgtcggtaccttacgtttaccggtacgtttacccgggaacccgtaaacgggtaaaccgtaaaggtgtaacgttaaaccgtacgtaaaacgggtacttcgggtacggtccgttacggaaacccttacccggttaactttccggtttccgtttaccgtttacccgttaaccgtttcccccttccccggtaaccttaacgttaccggttacggtaacggttaacccgttaaaccgggg

SEQ ID NO: 345131 - DNA, 783 bp, Homo sapiens
  misc_feature: GZ8MTXP01BVS6O.15.8.A08.1.454.CMB.2.raw
  modified_base (169)..(169): a, c, t, g, unknown or other
  misc_feature (169)..(169): n is a, c, g, or t
  modified_base (374)..(374): a, c, t, g, unknown or other
  misc_feature (374)..(374): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggggaaancgccaccctctcctgcagggccagtcagagagttgccgctagtttagcctaggtaccaacagaaacctcggccagcctccgaggcctcctacatctatgctgcctactcctaagttacgggactacgttggacctccccagtccgtaggttccaggtcgggctagggttcgggtctggaccagacggtactttccccaccgttcncccaaccctatacccgagcccgacccggcccccgtagtagttccgttaagggaaagtttacgttttcgtaccgtttaagttttaacgttacgttacggtacctaaagtaaaccttaaattaaacgttaaaaccggaaggttacccggtaccctttaaccgtttacccggggttaaccggttttaccccggggaaaccccggtaaaccgggggtaaaaccccgttaaaaggttacccggggtaaattaaacccgtaaaccggtaaaaccccggttagtcgggtttaacgggctttacccggaccctaaacccttcgttttaaccgtcggttttacccttaccggttacccgtttccccttacccccgaaccttaagtccccgttaagttaaccgttaaccgtttaacggg

SEQ ID NO: 345132 - DNA, 562 bp, Homo sapiens
  misc_feature: GZ8MTXP01CZORS.15.8.A08.1.454.CMB.2.raw
  modified_base (402)..(402): a, c, t, g, unknown or other
  misc_feature (402)..(402): n is a, c, g, or t
  modified_base (437)..(437): a, c, t, g, unknown or other
  misc_feature (437)..(437): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcaggccagtcagagagttgccgcctagtttagcctggtaccaacagaaacctggccagcctccaggcctcctcatctatgctgcatcctaagttacgggactacgtggtaactcccagccaggttcaggtggcaggttcgggtctggcacaggtacgtttccccacttctaccaacctataccgacgccacgccccgactacggtcgtagtaaagttntttgacttaagtttatactgtacagtactaataanaacaagtcgactagttcgtacttccggaccaagggaccaaagtgataanactaaacgtatgnggtctcgctaccnttactgttacttcttcttccttccccgctactcttacgcgttccgtaagg

SEQ ID NO: 345133 - DNA, 693 bp, Homo sapiens
  misc_feature: GZ8MTXP01DHGNG.15.8.A08.1.454.CMB.2.raw
  modified_base (171)..(171): a, c, t, g, unknown or other
  misc_feature (171)..(171): n is a, c, g, or t
  modified_base (297)..(297): a, c, t, g, unknown or other
  misc_feature (297)..(297): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccggggggaaanacgcccaccctctcctgcgagggccagtcagagtgttcgccgcctagttttacgccctaggtaacccaaacgacgaaacctgggaccctacgccctacccaggtcctccttagtctagtcgcctanctactacgtagtacggacgtacgtacgtacgtaccgtacgtacgtacggtacgtaggtcggtacgtaggtcgggtcgtcggacgacgtacgtacgtctaccctacctacacctactaccgaacgacgccgccgtacgtacgtacgtacgtaagttagtttacgttacgttagtttacttacgtacgtacgtaacgtaactaaacttaactaacgtacggtacgtacttacgttaccgttaccgggttaccggtaccggtaacggtaacgtaacggtagtacgtaacgtaacgtaacgtacgtacgtcgtcgtaacgtcttactacgttcgttcgttcttaccgttccttaccttaacccgtactaacgtcgtacgttacgtaacgttaacgtaacg

SEQ ID NO: 345134 - DNA, 601 bp, Homo sapiens
  misc_feature: GZ8MTXP01EALUO.15.8.A08.1.454.CMB.2.raw
  modified_base (168)..(168): a, c, t, g, unknown or other
  misc_feature (168)..(168): n is a, c, g, or t
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgccagggccagtcagagagttgccgccagtttagcctggtaccaacagaaacctggccagcctccagctctcatcatgctgcatccattaggacactggtaaccnccagcgtagtcagtggacgtaggtggtcnggacagtagtacgttcccactcaccactactaacagccgaccgcccgagtacgtcgtagtaattgttttacgacttagttattactagtactagtactaaataataaacgtaacgtacgtacctacttacgtacgttaccggtaccgaacggaacgtaaagtacgtaagtaactaacgtaaacgtaacgtacgtggtaacgtacgacctaccttacgttcgttcgttcgtttccttaccgtttcccgtaccgtaacgtcgtacgttacgtaacgttaacgtaacg

SEQ ID NO: 345135 - DNA, 594 bp, Homo sapiens
  misc_feature: GZ8MTXP01DZB1F.15.8.A08.1.454.CMB.2.raw
  modified_base (395)..(395): a, c, t, g, unknown or other
  misc_feature (395)..(395): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagagccaccctctcctgcagggccagtcagagagttgccgcctagtttacgcctggtaaccaacagaaacctggccagcctccaggcctcctcatctatgctgcatccagttacgggactacgtggtactcccgagtccgaggttcaggtggcgtaggttgggtctggacacgagtacgttcccactctacaccatacacgccacgcccgatagtcgtagaaagttntttgacttaagtttactacgtgtacagtactaaatataacagtcgtactacgttacgtaccgtttcggacccgaaggaaccgtaagtagtattaactaacgtaaacgtacgtggtacggtctacgctaaccttacgttcgttcttcttcttaccttcccgttaccctcctacttcgttacggtaacgttcgttaaacgg

SEQ ID NO: 345136 - DNA, 638 bp, Homo sapiens
  misc_feature: GZ8MTXP01EZOZB.15.8.A08.1.454.CMB.2.raw
  modified_base (170)..(170): a, c, t, g, unknown or other
  misc_feature (170)..(170): n is a, c, g, or t
  modified_base (231)..(231): a, c, t, g, unknown or other
  misc_feature (231)..(231): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctcctgcagggccagtcagagagttgccgctagtttacgcctggtaccaanacgaaacctggccagccctccaggcctcctcatctatgctgcagtccagttacgggactacgtggtactccccgagcctaggtttcaggtggcaggttgggtcctggcacgagtcgttcccacttcacacctaggtcccaagccaacgccccgactaggttacctagggtaaagttttcgtttacgtacgtttaacgtttaacgttacgttacgttacgtaacgtaacttaaagtaaacgtaaacgtacgtacgtaccttacgttaccgtaccgttaccggacccgtaacggaacgtaagtagtaactaactaacgtaacgtacgtcggtcgtctacgactacttacgttcgttacttcgttcttaccttccttcctccgtctacgttacgtaacgttaacgtaacg

SEQ ID NO: 345137 - DNA, 674 bp, Homo sapiens
  misc_feature: GZ8MTXP01A6KHC.15.8.A08.1.454.CMB.2.raw
  modified_base (168)..(168): a, c, t, g, unknown or other
  misc_feature (168)..(168): n is a, c, g, or t
  modified_base (444)..(444): a, c, t, g, unknown or other
  misc_feature (444)..(444): n is a, c, g, or t
  modified_base (646)..(646): a, c, t, g, unknown or other
  misc_feature (646)..(646): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaancgccaccctctcctgcgagggccagtcagagagttgccgcctagtttagcctaggtaaccaagagaaacctggaccacgcctacccaggtcctcctcatctaatgctagctatccgagttacggacctaacgtcggtaactccccgaagtccccgtaaggtttccgaagttcgggcctagggtttcggggtcctggacaaccgaggtacttccaaccttcaccgaactacacgagccgtaacgccccgtatacgtacgtagaaagtttcgttttanacgttaagttactacgtacgtacaacgtaacttaaagtaacgtaacgtaacgtcgtaccttacgttaccggttaaccggttaccgggaacccgaaacgggtaaaccgtaaagtacggtaaacgtaacgtaaccgaaacggtacgtggtccgtaactacgacctaccgttacgttcttacgttccttcaccgttccctacccnctacgtcgacgtaacgttaaccggtaag

SEQ ID NO: 345138 - DNA, 625 bp, Homo sapiens
  misc_feature: GZ8MTXP01CEAKC.15.8.A08.1.454.CMB.2.raw
  modified_base (169)..(169): a, c, t, g, unknown or other
  misc_feature (169)..(169): n is a, c, g, or t
  modified_base (357)..(357): a, c, t, g, unknown or other
  misc_feature (357)..(357): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttgccgcagtttagcctaggtaccaacagaaacctggccacgcctcccgaggctcctcatctatgctgcatccagttacggacagtggtactcccagtccaggttcaggtggcagggtggtctggacacgagtagttccccactctcgaaccctntaccacgcaccgcccgactagtctaggtaacgttatttcgcttaagtttacttacgtagtacaagtactaaataacgtaacgaagtcggtacctagtttaccgtacgtttaccggacccgaagggtaacctaaaggtacgaattaacgtacgtaaaacgtacgtacggtcggctacggactaccttacttccgtctttccgttcttaccctttcccgttaccccgtaaccttacgtaccgttacgtaacggttcccgtttaaaccggg

SEQ ID NO: 345139 - DNA, 679 bp, Homo sapiens
  misc_feature: GZ8MTXP01CQ46B.15.8.A08.1.454.CMB.2.raw
  modified_base (170)..(170): a, c, t, g, unknown or other
  misc_feature (170)..(170): n is a, c, g, or t
  modified_base (433)..(433): a, c, t, g, unknown or other
  misc_feature (433)..(433): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaanacgccaccctctctgcagggccagtcagagagttcgccgctagtttacgcctaggtaaccaacaagaaacctggaccacggccctacccgaggcctcctctactctatcgctgactactacctaagttacgggactacgtggtacctccccgagcccgtaggttccaaggttcggaccgtagggttcggggtactggacctaacgtagtacgtttacccacctctaccaccatcacgccacgcccgagtacgtctagtaaatntttgactaagtttatactgtacgaagtactaaataataaacgagtacgtaccttattaccgtacgtttacccggggaacccgtaacggggtaaaccctaaaagggtacggtaaattaacgtaaccgtaaaacgtaccgtggtacggtcgtacgacctaaccttacgttcgtacgtttccttccttaccgtttcccctaccccggtaactacgttaccgttacggtaacgttaaccgttaaaccggg

SEQ ID NO: 345140 - DNA, 616 bp, Homo sapiens
  misc_feature: GZ8MTXP01A1ZOQ.15.8.A08.1.454.CMB.2.raw
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatccccagccaggttcagtggcagtgggtctggcanagnttccactcncaccatcagcacgcccgnagtcagaatntttgactagtttattactgtacagactaataataaacaagtcggtaccctattccgtaacgttttaccgggaccccgtaacggggaaaccctaaaggtggtaataaacgtaccgaaaacgtaaccgttgggtcgggtaacttacggaccctaacccgttaattcccgttggttacccgttttccttaaccgtttccccttttacccccggaacccttaacttccgttacgggaaccgttccgttaaacccgggg

SEQ ID NO: 345141 - DNA, 565 bp, Homo sapiens
  misc_feature: GZ8MTXP01ALKV1.15.8.A08.1.454.CMB.2.raw
  modified_base (353)..(353): a, c, t, g, unknown or other
  misc_feature (353)..(353): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctccaggctcctcatctatgctgcatccattagggacactggatcccagccaggttcagtggctaggtggtctggcacagagttccactctcacatcagcagccccgtanacgtctagtaaattctttagacttagtttattacgtgtactatactaataactaaacgtacgtacgtactacgttacgtaccgtttaccggaccgtaacgggaaccaaagtgaactacgtaacctaaacgtaacgtggtcgcgtcgcctacttacgttcgtcgttcttcgttacttcccgtcccgtcctacgtcgttacgtcgttcgtaacg

SEQ ID NO: 345142 - DNA, 657 bp, Homo sapiens
  misc_feature: GZ8MTXP01B5OUW.15.8.A08.1.454.CMB.2.raw
  modified_base (171)..(171): a, c, t, g, unknown or other
  misc_feature (171)..(171): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagcccaccctgtctgtgtcgtaccgggggaaancgccaccctctcctgcagggccagtcagagagttcgccgcctaggtttacgcctaggtaaccaacaacgaaacctggcccacgccctcccaggcctcctcatctatgctgcactacctagttacggactacgtcggtactccccgagccctaggttcgaggtcggtcgtagggttcgggtcgtggaccagtacgtacgttccccaccttctaccaacctatacccgaagcccgacgccccgtactaacggtcttagggtaaacgtttagtttacgtacgttagttttaactcgttagtcaaacgtataataactaacgagtcggtacctagttccggtacggttaccggaccgtaaaggtaacctaaggtaggtaactaacgttaaccgaaagtacggtcggtcgtaacgtcgttacacttacgttccttacgttcttcttaccttcccgtcccctaacttacgtcgttacgcgttaacgtaacgg

SEQ ID NO: 345143 - DNA, 616 bp, Homo sapiens
  misc_feature: GZ8MTXP01C1E83.15.8.A08.1.454.CMB.2.raw
  modified_base (169)..(169): a, c, t, g, unknown or other
  misc_feature (169)..(169): n is a, c, g, or t
  modified_base (595)..(595): a, c, t, g, unknown or other
  misc_feature (595)..(595): n is a, c, g, or t
  modified_base (609)..(609): a, c, t, g, unknown or other
  misc_feature (609)..(609): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaancgccaccctctccgtgcagggccagtcaggagagttcgccgccagtttacgcctaggtaccaaacgacgaaacctcggcccacgccctcccaggcctcctcatctatgctgcatccaagttacggactgtcggtactcccacgccaggttccaggtggcagggttcggctggacaacgtgtacgtttaccccacttctccaaacctataccaacggccacgggtccccgcgtaacgtccgtaggtaaacgtgttttcgtacgttaggtttaacttacttacggttacaacgtacctaaagtaataaacgacgtacggtacctacgttacgtaccgtttccggacccgtaacggaacgaacgtagataacgtacaaacgtacgtgtggaactcgttactacacgttcgtcttcttccattccttccnctactcgttagtcncgtaacg

SEQ ID NO: 345144 - DNA, 608 bp, Homo sapiens
  misc_feature: GZ8MTXP01A2F9J.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttgccgcctagtttacgcctggtaaccaacagaaacctggccagcctccaggctcctcatctatgctgctatccagttagggacacgtggactccccagcctaggttcaggtggctaggtcggtctggcacgagtcttccactctcaccatccagccacggcccactaggtcctaggaaagttttctttcgacttaagtttactacgtgtacgtaacgtaactaaactaaactaaacgtaacgtacgtacctacgttacggttacgttaccggtaccggtaacggtaaaccgtaaagtaagtaacgtaactaacgtaaacgtaacgtacggtgtcgtcgactacttacgtcgttcgttcgttcttctcccttcccgtcctactcgttacgtaacgttaacgtaacg

SEQ ID NO: 345145 - DNA, 741 bp, Homo sapiens
  misc_feature: GZ8MTXP01CN649.15.8.A08.1.454.CMB.2.raw
  modified_base (168)..(168): a, c, t, g, unknown or other
  misc_feature (168)..(168): n is a, c, g, or t
  modified_base (657)..(657): a, c, t, g, unknown or other
  misc_feature (657)..(657): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttacgccttaggtaacccaacgagaaaccgtgggacccaacgccctcccgacggcctaccctctaatctaatcggcttagcataccagttagggacctacgtggttactccccgaagcctagggtttaccaaggttcggacgtagggttcggggtctaggaccaacgtcgacgttttcccaaccgttcctacgaaccctacgtaaccgaacggcccacggtaccccgacgttacgtaccgtagggtaaaacgttcgtttttacgggaccttaagggtttttaaatacccgtggttaaccctaaaggtaccttaaaactagttaaaccgaagttccggtaccctacgtttacgttaacccggtttaccgggaccccgaagggtaaacgtaaacgtggtaaacttaacgtaacgtaaacgtaacgttggtcgaacgttcgcctaaccncgtttaccgtcgtttaccgttccgttaaccttccccgtaccccgtcttacggttacgttaccgttaacggttaaccgtaaccgg

SEQ ID NO: 345146 - DNA, 606 bp, Homo sapiens
  misc_feature: GZ8MTXP01BMTSV.15.8.A08.1.454.CMB.2.raw
  modified_base (169)..(169): a, c, t, g, unknown or other
  misc_feature (169)..(169): n is a, c, g, or t
  modified_base (259)..(259): a, c, t, g, unknown or other
  misc_feature (259)..(259): n is a, c, g, or t
  modified_base (373)..(373): a, c, t, g, unknown or other
  misc_feature (373)..(373): n is a, c, g, or t
  modified_base (540)..(540): a, c, t, g, unknown or other
  misc_feature (540)..(540): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttgccgcctagtttagcctaggtaccaacagaaacctggccagcctccgagctcctnatctatgctgcatccagttaggactacgtggtactcccgagcctaggttcaggtcgctagggttggtctggacacacgtgttcccactctacaccctagtcagcacgccccganacgtctagagttatttgacttagtttactactcggtataacgactaattaactaacgacgtcggtaccttacgttccgtaccggttttaccccggacccgtaagggaaaccctaagtcggtaataacgtaccgaaaaccggtactggtcgtcgtcgacctaaccttntaccggttcttaccttcaacgttcccttcccgaactacgtcgttaacgtcggttaacttaaccggg

SEQ ID NO: 345147 - DNA, 658 bp, Homo sapiens
  misc_feature: GZ8MTXP01DMPHL.15.8.A08.1.454.CMB.2.raw
  modified_base (423)..(423): a, c, t, g, unknown or other
  misc_feature (423)..(423): n is a, c, g, or t
  modified_base (632)..(632): a, c, t, g, unknown or other
  misc_feature (632)..(632): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgccacccctctcctgcagggccagtcagagagttcgccgcctagtttacgcctaggtaaccaaacagaaacctggcccacgcctccaggctcctcatctatgctgcataccagttacgggactacgtggtactcccagccaggttcgagtggacgtaggttcgggtctggaccaacgaggtactttcccaccttctaccaccctataaccgagccacggcccccgacgtacgttccgtaggttaaaggttntttttacgacgtttaagttttacttactcgtaacaacgtactaaattaacgtaaaccgaaggtccgtaccttacgtttaccggtaacccgtttccggggaccccgaaaggggtaaaccctaaagggtgaacttaaacaacctaaaacgtaacgtggtacggaacttcgaacctacttagttctgtttccttcttacttcccgttacccnctatcgttagtaaccgttcgttaacg

SEQ ID NO: 345148 - DNA, 650 bp, Homo sapiens
  misc_feature: GZ8MTXP01BLTLB.15.8.A08.1.454.CMB.2.raw
  modified_base (169)..(169): a, c, t, g, unknown or other
  misc_feature (169)..(169): n is a, c, g, or t
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccaccctctcctgcagggccagtcagagagttgccgccagtttacgcctaggtaccaacagaaacctggccacgcctccaggctcctcatctangctgcatccattaggacacgtggactcccagccaggttcaggtgacnggtgggtctggacacaggtacttcccacttcacacccataccgaacgccaacggcccccgngtacgttccgtaggtaaacgtttnttttacggtacttaggttttactacgttgttaccaagtactaaattactaaacgaacgtcggaccttactttaccgtacgtttacccgggacccgtaaacggggtaaccctaaaggtaggaacttaaagtaaccgtaaaacggtaaccgttggtaacgggtcttacgggacctacccgttattcccggtttcttccgttccttaccgttccccgtccgtccttacgtaccgttacggtaaccgttaacgtaacg

SEQ ID NO: 345149 - DNA, 743 bp, Homo sapiens
  misc_feature: GZ8MTXP01BNC3K.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgcccaccctctcctgcgagggccagtcagagtagttcgccgcctagttacgcctaggtaaccaacaagaaacctcggccacgccctccgaggtcctcctcatctatcgctgctacgtacctagttacgggactacgtggtaacctcccgagtccgtaggttacaggttcggaccgtagggtcgggtcgtaggacaacgaggtacttccacctctacgaccatacccgagcccgaacgccccgtacacgttactaggtaaacgtttctttacggacctttaaggtttttaaactcccgtttaggacctaacgtaactaaacttaaactaaaccgggtaagttccggtaccctttaagtttaccccggggttacggttttaaccccggggaacccgaaacggggtaaaccttaaaaggggtcgttaaacttaaacgtaaacccggtaaacgtacggtccggtacggaacctacgttaacctaacccgttgtttaccgtttaccgttacccttcgttaccccgtttccccgtacccgaacttcgtaccggttacggtaacggttcccgtaaggg

SEQ ID NO: 345150 - DNA, 658 bp, Homo sapiens
  misc_feature: GZ8MTXP01ERUAU.15.8.A08.1.454.CMB.2.raw
  modified_base (169)..(169): a, c, t, g, unknown or other
  misc_feature (169)..(169): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaancgccaccctctcctgcagggccagtcagagagttgccgcctagtttacgcctggtaaccaacgagaaacctggaccacgccctccaggctcctcatctatgctgcatccagttacggacacgtggtactcccagcctaggttcaggtcgacgnggtggtctggccacgagtacgttccactcncaccataccagccacgccccgtacgacgtccgtaggtaaattacgttttacgtacgttaacgttttaacttactacggtactaacggaactaaataacgtaaactaaggtccggtaacctacgtttaccgtaaccgttttcccgggaacccgtaacggggtaaccctaaaggtacgtaacgtaaacgttaaccgaaacgtaaacgtgttcggaactcggacctaccttaacttccgttcgttacgtttccttacctttcccgttccccggtcctattccgttacgtaaccgttccgttaaaccggg

SEQ ID NO: 345151 - DNA, 679 bp, Homo sapiens
  misc_feature: GZ8MTXP01EXHP4.15.8.A08.1.454.CMB.2.raw
  modified_base (169)..(169): a, c, t, g, unknown or other
  misc_feature (169)..(169): n is a, c, g, or t
  modified_base (475)..(475): a, c, t, g, unknown or other
  misc_feature (475)..(475): n is a, c, g, or t
  modified_base (500)..(500): a, c, t, g, unknown or other
  misc_feature (500)..(500): n is a, c, g, or t
  modified_base (623)..(623): a, c, t, g, unknown or other
  misc_feature (623)..(623): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccggggaaanacgcccaccctctcctgcgagggccagtcagagagttcgccgcctagtttacgcctaggtaaccaacgaacgaaacctcgggacccacggccctccgacggtcctcctcgatctagtcgctgctataccaagttacgggactacgttggtacctccccgacgtaccgtaggtttcgagggttcggacgtacgggttcgggggttacctaggggaccaacgtacggtacgtttaccccacctttccaccaaccctacgtaaccgaacgccgaacgccccgtacgtacgtttacgtaggtaaagtttnttttcgactttaagtttacttacgngttacaagtactaaataacgtaaacgtacgtcgtactactttccggtaccgtttacccgggaaccggtaacggaaacctaaaggtcggtaaactaactacgaaaccgtagtggttacgctacncacttactctaacgttcttacttcttcccgtccaactagtcagtcgttccgtaagg

SEQ ID NO: 345152 - DNA, 659 bp, Homo sapiens
  misc_feature: GZ8MTXP01D4OZE.15.8.A08.1.454.CMB.2.raw
  modified_base (171)..(171): a, c, t, g, unknown or other
  misc_feature (171)..(171): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtccgtaccgggggaaanacgccaccctctcctgcaggggccaggtcaggacgagttcgccgacctagttttacgcctagggtaacccaaacgaacgaaacccttgggacccacgccccttcccgaggcctcctcatctatgctgcatccagttacggacactggtactccccagtcctagggtttccaggtgcgaggttcggggtactggacacgagtacgttccacttcacaccctagtcccagcctacgcccgactagttcgagtaagtntttagntacgtttattactgtacagataatacgtaagtagtacggacctagttcccgtaacgtttccgggaccccgtaaagggaaaccgtaagtagggtaattaaacgtaccgtaaaaccgtacggtttgtccgggaagtaacccgaccgtaccgttacgttacgttcgttaccgttccttaccttaaccctacccgtcccgtacttacgttacggtaacggttaacgtaacg

SEQ ID NO: 345153 - DNA, 486 bp, Homo sapiens
  misc_feature: GZ8MTXP02IRXL0.15.8.A08.1.454.CMB.2.raw
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (481)..(481): a, c, t, g, unknown or other
  misc_feature (481)..(481): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccgnagtctgaaagtntttgcagtttatactgtcagcaatataacagtgccattcactttcgcccagggaccaaagtggatatacaaacgaactgtaggctgcaccatctgtcttcatctcccgctactctgacnctacg

SEQ ID NO: 345154 - DNA, 490 bp, Homo sapiens
  misc_feature: GZ8MTXP02FWQMV.15.8.A08.1.454.CMB.2.raw
  modified_base (168)..(168): a, c, t, g, unknown or other
  misc_feature (168)..(168): n is a, c, g, or t
  modified_base (351)..(351): a, c, t, g, unknown or other
  misc_feature (351)..(351): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccgnagtctgaagtatttgctagtttatactgtcagcaatataacaagtgaccattcactttcgccagggaccaaagtggatatacaaacgaactgtggctgcaccatctcgtctcactcttccnctactctanacgtctacg

SEQ ID NO: 345155 - DNA, 508 bp, Homo sapiens
  misc_feature: GZ8MTXP02JNYAE.15.8.A08.1.454.CMB.2.raw
  modified_base (227)..(227): a, c, t, g, unknown or other
  misc_feature (227)..(227): n is a, c, g, or t
  modified_base (383)..(383): a, c, t, g, unknown or other
  misc_feature (383)..(383): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaanagaaacctggccagcctcccaggctcctcatctatgctgcatccattagggacactggtatccagccaggttcagtggcagtgggtctggcacagagttccactctcaccatcagcacgcccgcagtctgaagtatttgctagtttatactgtcanacatataacagtacgtactattactacgttcgtaccgacggacgaacgtagagtatacaacgtacgtagtgtcgtcgacacactctcgtctctactcgtcctacctactctcgtacgtacgtacg

SEQ ID NO: 345156 - DNA, 483 bp, Homo sapiens
  misc_feature: GZ8MTXP02GC7DA.15.8.A08.1.454.CMB.2.raw
  modified_base (168)..(168): a, c, t, g, unknown or other
  misc_feature (168)..(168): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatccagccaggttcagtggcagtgggtctggcacagagttccactctcaccatcagcagcccgnagtctgaagtnttttgctagttattactgtcagcaatataacagtgaccattcactttcgccagggaccaagtgatatcaaagactgtggactgcaccatctcgtctcactcttccgctactctgacgctacg

SEQ ID NO: 345157 - DNA, 517 bp, Homo sapiens
  misc_feature: GZ8MTXP02FXWYY.15.8.A08.1.454.CMB.2.raw
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccactttagcctggtaccaacagaaacctggccagcctcccaggctcctcatctatgctgcatccattagggacactggtatcccagccaggttcagtggcaggtgggtctggcacagagttccactctcaccatcagcagcccgnagtctagaaatnttttgctagtttattactgtcagactaatataacgaagtcggacctattctacgtttccggaccctagggaaccaaagtggatagtacaaacgaactgtcggactcgcaccatctcgtacttcactccgttcccgctactctgacgtctaacg

SEQ ID NO: 345158 - DNA, 499 bp, Homo sapiens
  misc_feature: GZ8MTXP02IXUG7.15.8.A08.1.454.CMB.2.raw
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtggtctggcacagagttccactctcaccatccagcagccccgnagtctgaagtatttgctagtttatactgtcagcaatataacagtgaccattcactttcggcccagggaccaaagtggatatacaaacgaactgtggctgcaccatctgtcttcactcgtttccccgctactcgtacgacgtactacg

SEQ ID NO: 345159 - DNA, 551 bp, Homo sapiens
  misc_feature: GZ8MTXP02GD8X6.15.8.A08.1.454.CMB.2.raw
  modified_base (168)..(168): a, c, t, g, unknown or other
  misc_feature (168)..(168): n is a, c, g, or t
  modified_base (354)..(354): a, c, t, g, unknown or other
  misc_feature (354)..(354): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggctccctcatctatgctgcatccattagggacactggtatcccagccaggttcagtggcagtgggtctggcagagagttccactctcaccatcagccagcccgnagtctagaagtatttgctagtttatactgtcagcaatataacaagtcggacctattcctacgtttccggacccgtaaggggaaccctaaagtcgggaatagtaccaaacgtaactggtcggacttcggacctacctacttcgtcgttccttactacttcccgtttccccgacctacttcctagacgtacttaaccgg

SEQ ID NO: 345160 - DNA, 494 bp, Homo sapiens
  misc_feature: GZ8MTXP02IVTAR.15.8.A08.1.454.CMB.2.raw
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctatgctgcatccattagggacactggtatcccagccaggttcagtggcagtgggtctggcacagngttccactctcaccatccagcagccccgnagtcngaagtntttgctagtttatactgtcagcaatataaacagtgacctattcactttcgcccagggaccaaagtggatatacaaagaactgtgctgacacatctgtcttcatccttcccgctactctgacgtctaacg

SEQ ID NO: 345161 - DNA, 488 bp, Homo sapiens
  misc_feature: GZ8MTXP02JEP34.15.8.A08.1.454.CMB.2.raw
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcaggtggtctggcacagngttccactctcaccatcagcagcccgnagtctgaatntttgctagttatactgtcagcaatataacagtgccattcactttcgccctagggaccaaagtggaatatacaaacgactgtggctgcaccatctcgtcttcactctcccgcactctagacgctaacg

SEQ ID NO: 345162 - DNA, 527 bp, Homo sapiens
  misc_feature: GZ8MTXP02I5C1J.15.8.A08.1.454.CMB.2.raw
  modified_base (168)..(168): a, c, t, g, unknown or other
  misc_feature (168)..(168): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccgnagtctgaaagttnttgctagtttatactgtacagactaatataacagtcgactattactacgtttccgaccgacgggaaccaaaggtaggactactacgaaacgtacgtagtacgctacgaccacctactcgtcgtcttactacttccgtcccgactactctacgtacgtactacg

SEQ ID NO: 345163 - DNA, 497 bp, Homo sapiens
  misc_feature: GZ8MTXP02FU3WW.15.8.A08.1.454.CMB.2.raw
  modified_base (169)..(169): a, c, t, g, unknown or other
  misc_feature (169)..(169): n is a, c, g, or t
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagngccaccctctcctgcagggccagtcagagagttgccgccagtttagcctggtaccaacagaaacctggccagcctcccaggctcctcatctatgctgcatccattagggacactggtatcccagccaggttcagtggcaggtgggtctggcacagagttccactctcaccatcagcagcccgnagtctagaagtatttgctagtttatactgtcagacaataataacaagtggacctattcactttcggacccagggaccaaagtgaatagtacaaacgactgtgctgcacatctcgtctcatcttcccgctactctgacgtactacg

SEQ ID NO: 345164 - DNA, 499 bp, Homo sapiens
  misc_feature: GZ8MTXP02H1CTC.15.8.A08.1.454.CMB.2.raw
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagcccaggttcagtggcagtgggtctggcanagtagttccactcctcaccatcagcagcccncagtcngaagtntttgctagtttattactgtcagacaatataacagtgcctattctactttccggccagggaccaaagtggatatacaaagactgtagctgcacatctcgtcttcacttccgtcccactactctgacgtactaacg

SEQ ID NO: 345165 - DNA, 493 bp, Homo sapiens
  misc_feature: GZ8MTXP02IJAD8.15.8.A08.1.454.CMB.2.raw
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (473)..(473): a, c, t, g, unknown or other
  misc_feature (473)..(473): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccnagtctgaaatntttgctagtttatactgtcagcaaatataaacaagtgacattcactttcgcccagggaccaaagtggatatacaaacgaactgtagctgcacatctgtcttcatcttccccnctactctacgacgtactacg

SEQ ID NO: 345166 - DNA, 487 bp, Homo sapiens
  misc_feature: GZ8MTXP02I0549.15.8.A08.1.454.CMB.2.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctctcatctatgctgcatccattagggacactgtatccagccaggttcagtgcagtggtctggcacagagttccactctcaccatcagcagcccgnagtctagaagtntttgctagtttatactgtcagacatanaacagtgactattcactttcgcccgaggaccaaagtgatatacaacgaactgtgctgcacatctcgtcttcactccttcccgctactcgtcgactactaacg

SEQ ID NO: 345167 - DNA, 489 bp, Homo sapiens
  misc_feature: GZ8MTXP02F0MY1.15.8.A08.1.454.CMB.2.raw
  modified_base (351)..(351): a, c, t, g, unknown or other
  misc_feature (351)..(351): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcagcccgnagtctgaagtatttgctagtttattactgtcagcaatataacaagtgaccattcactttcgcccagggaccaaagtggatatacaaacgactgtaggctgcaccatctgtctcatccttcccgcactctgacgctacg

SEQ ID NO: 345168 - DNA, 491 bp, Homo sapiens
  misc_feature: GZ8MTXP02FU0MA.15.8.A08.1.454.CMB.2.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtaatgacgcagtctccagccaccctgtctgtgtctccgggggaaagagccaccctctcctgcagggccagtcagagagttgccgccagtttagcctggtaccaacagaacctggccagcctcccaggctcctcatctatgctgcatccattagggacactggtatccccagccaggttcagtggcagtgggtctggcacagagttcacctcncaccatcagcngcccgnagtcngaagtnttttgctagtttattactgtcagcaatataacagtgctattcacttcggccagggaccaaagtcgatatacaaaacgactagtgctcgcaccatctgtcttcatctcccgcactctgacgctacgtacg

SEQ ID NO: 345169 - DNA, 502 bp, Homo sapiens
  misc_feature: GZ8MTXP02HXWE1.15.8.A08.1.454.CMB.2.raw
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtggtctggcacagagttccactctcaccatcagcagcccgnagtctgaatntttgctagtttattactgtcagcaatataacagtcgactattacactttcggaccctagggacccaaagtaggatatacaaacgaactgtggctgcacatctcgtcttcactccttcccgcctactctacgacgtactaacg

SEQ ID NO: 345170 - DNA, 485 bp, Homo sapiens
  misc_feature: GZ8MTXP02IWCA0.15.8.A08.1.454.CMB.2.raw
  modified_base (288)..(288): a, c, t, g, unknown or other
  misc_feature (288)..(288): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtancccagccaggttcagtgcagtggtcnggcacagnttccactctcaccatcagcagcccgnagtctagaagtntttgctagtttatactgtcagcaatataacagtgacctattcactttcgccaggaccaaagtgatatacaaacgactgtggctgcacatctgtcttctatccttcccgcactctagacgctaacg

SEQ ID NO: 345171 - DNA, 578 bp, Homo sapiens
  misc_feature: GZ8MTXP02IW9P0.15.8.A08.1.454.CMB.2.raw
  modified_base (263)..(263): a, c, t, g, unknown or other
  misc_feature (263)..(263): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctangctgcatccattagggacactggtactcccagccaggttcagtggcaggtgggtctggcacgagtagttccactctcaccatcagcacgcccgnagtctagaatntttgctagtttatactgtcagacaatataacagtcgacctattctaccgtttcggaccccgtaacgggaaccctaaaggtcggtaataactaacgaaaaccgtaacgtaggtacggtcgtacgaccaaccctattaccttacgttacctttcctaacgtttccctttaccccgaccctaacttaccttcggaacggttacctttaaccgg

SEQ ID NO: 345172 - DNA, 502 bp, Homo sapiens
  misc_feature: GZ8MTXP02HUHSM.15.8.A08.1.454.CMB.2.raw
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtggggtctggcacagagttccactctcaccatccagcagcccgnagtcngaatatttgctagtttattactgtctagactaatataacagtaggcattctactttcgccctagggaccaaagtcggatatacaaacgaactagtgctgcaccatctcgtcttcattctcccgcctactctcgacgtactaacg

SEQ ID NO: 345173 - DNA, 500 bp, Homo sapiens
  misc_feature: GZ8MTXP02ILLOA.15.8.A08.1.454.CMB.2.raw
  modified_base (168)..(168): a, c, t, g, unknown or other
  misc_feature (168)..(168): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagngttccactctcaccatcagcagcccgnagtctgaatntttgctagtttatactgtcagactaatataacagtgacctattcactttcgaccctagggaccaaagtcgatatacaaacgtaactgtggctgcactatctcgtacttcactcttcccgctactctacgacgtactacg

SEQ ID NO: 345174 - DNA, 498 bp, Homo sapiens
  misc_feature: GZ8MTXP02HCR38.15.8.A08.1.454.CMB.2.raw
  modified_base (168)..(168): a, c, t, g, unknown or other
  misc_feature (168)..(168): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (479)..(479): a, c, t, g, unknown or other
  misc_feature (479)..(479): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatcatgctgcatccattagggacactggtatcccagccaggttcagtggcagtggtctggcacagagttccactctcaccatcagcagcccncagtctgaaagttntttgctagttatactgtcagacaataataacgagtcgactattcctacgtttcgaccgacgggacaagtgatatacaaacgacgtgtcgctgacactatctcgtctcactccgtccnctactctacgacgtctacg

SEQ ID NO: 345175 - DNA, 507 bp, Homo sapiens
  misc_feature: GZ8MTXP02IIV2Y.15.8.A08.1.454.CMB.2.raw
  modified_base (257)..(257): a, c, t, g, unknown or other
  misc_feature (257)..(257): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctnatctatgctgcatccattagggacacgtggtactcccagccaggttcagtggcagtggtctggcacagattccactctcaccatcagcacgcccgnagtctgaagtntttgctagtttatactgtcagacaatataaacaagtgacctattcactttcgacccagggaccaaagtggatatacaaacgaactgtcggctgaccactatcttcgtacttcacttccttcccgactactcctgacgtctacg

SEQ ID NO: 345176 - DNA, 490 bp, Homo sapiens
  misc_feature: GZ8MTXP02JXXGP.15.8.A08.1.454.CMB.2.raw
  modified_base (168)..(168): a, c, t, g, unknown or other
  misc_feature (168)..(168): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaacagaaacctggccagcctcccaggcctcctcatctatgctgcatccattagggacactggtatcccagccaggttcagtggcagtgggtctggcacngagttccactctcaccatcagcagcccgnagtctgaaagtntttgctagtttattactgtcagcaatataacagtgaccattcactttcgcccagggaccaaagtggatatacaaacgactgtaggctgcaccatctgtcttcatccttcccgcactctgacgctacg

SEQ ID NO: 345177 - DNA, 539 bp, Homo sapiens
  misc_feature: GZ8MTXP02IRM86.15.8.A08.1.454.CMB.2.raw
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaanagaaacctggccagcctcccaggctcctcatctatgctgcatccattaggacactggtactcccagccaggttcagtggcagtggtctggcanagattccactctcacatcagcagcccgnagtctgaaagttnttgntattatactgtcagactaataataacagtacgactattactacgtttccgaccgaacgggaaccgtaaagtacgaatacgtaacgaaacgtacgtagtacgtacgtacgacacctacttcgttcgtaccttactacttccgttacccgtacctactacgtacgtacgtactaacg

SEQ ID NO: 345178 - DNA, 498 bp, Homo sapiens
  misc_feature: GZ8MTXP02IE0KR.15.8.A08.1.454.CMB.2.raw
  modified_base (263)..(263): a, c, t, g, unknown or other
  misc_feature (263)..(263): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctangctgcatccattagggacactggtatcccagccaggttcagtggcaggtgggtctggcacagagttccactctcaccatcagcagcccgcagtcctgatactttgctagtttatactgtcagactaatataaacagtcgactattcactttcggaccctagggaccaaagtgatatacaaacgactgtaggctagcacatctctcttcactccttcccgcactctcgagtctacg

SEQ ID NO: 345179 - DNA, 533 bp, Homo sapiens
  misc_feature: GZ8MTXP02I9V47.15.8.A08.1.454.CMB.2.raw
  modified_base (367)..(367): a, c, t, g, unknown or other
  misc_feature (367)..(367): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttccactctcaccatcagcacgcccgcagtctaggaaagttntttgactagtttattactgtacagacaaataataaacgagtcgacctattcctacgtttccggacccgacgggaaccgaaaggtagaataactacgaaacgtacgtgtacggtctcgaccaccatctcgtcttcactccgtcccgactactctacgacgtactacg

SEQ ID NO: 345180 - DNA, 506 bp, Homo sapiens
  misc_feature: GZ8MTXP02GNGVF.15.8.A08.1.454.CMB.2.raw
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtactcccagcccaggttcagtggcaggtgggtctggcacgagagttccactctcaccatcagcacgcccgnagtctagaagtnttttgctagtttattactgtcagacaatataacagtgactattctactttcgcccgagggaccaaagtgatatacaaacgactagtgctgcacatctcgtcttcacttccgttcccgcctactcctagacgtactacg

SEQ ID NO: 345181 - DNA, 498 bp, Homo sapiens
  misc_feature: GZ8MTXP02JXE6F.15.8.A08.1.454.CMB.2.raw
  modified_base (168)..(168): a, c, t, g, unknown or other
  misc_feature (168)..(168): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctcctcatctatgctgcatccattagggacactggtactcccagccaggttcagtggcaggtgggtctggcacagagttccactctcaccatcagcagcccgnagtctgaatntttgctagtttattactgtcagacaatataacagtcgacctattcacgtttccggccagggaccaagtgatatacaaacgactgtgctgcacctatctcgtcttcacttcctcccgctactctgacgtctaacg

SEQ ID NO: 345182 - DNA, 513 bp, Homo sapiens
  misc_feature: GZ8MTXP02HY923.15.8.A08.1.454.CMB.2.raw
  modified_base (256)..(256): a, c, t, g, unknown or other
  misc_feature (256)..(256): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcaggccagtcagagagttgccgcagtttagcctggtaccaacagaaacctggccagccctccaggcctccctnatctatgctgcatccattagggacactggtactcccagccaggttcagtggcaggtgggtctggcacgagagttcccactctcaccatcagcagcccnagtctgaagtntttgctagtttatactgtcagacaataataacagtacgactattctacgtttcgaccaagggaccaaagtcggataagtacaaaacgtactgtacggctgacacatctcgtcttcactccttcccgactactctacgacgtactaacg

SEQ ID NO: 345183 - DNA, 546 bp, Homo sapiens
  misc_feature: GZ8MTXP02G02XZ.15.8.A08.1.454.CMB.2.raw
  modified_base (168)..(168): a, c, t, g, unknown or other
  misc_feature (168)..(168): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggcctcctcatctatgctgcatccattaggacactggtatcccagccaggttcagtggcaggtgggtctggcacagtagttccactctcaccatcagcagcccgnagtctgaagtntttgctagtttatactgtcagactaatataaacgagtcgacctagttactacgtttccggacccgaggggaacccaaaggtcggtaataacgtacaaaacgtactgtacggactcggacaccctatcctcgtccttcacttcccttccccgacctacttccgtacgtacgtacgttaacgg

SEQ ID NO: 345184 - DNA, 528 bp, Homo sapiens
  misc_feature: GZ8MTXP02H8OCQ.15.8.A08.1.454.CMB.2.raw
  modified_base (169)..(169): a, c, t, g, unknown or other
  misc_feature (169)..(169): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcagtttagcctggtaccaacagaaacctggccagccctcccaggcctcctcatctatgctgcatccattagggacactggtactcccagccaggttcagtggcaggtggtctggcacagagttccactctcacntcagcagcccnagtctgaaatntttgctagtttattactgtcagacaatataacagtacgacctattctacgtttccggacccgtagggacctaaagtacggataacgtacaaaacgtactagtacggctacgcacctattctcgtcttcacttccttcccgacctactcgtacgacgtactaacgg

SEQ ID NO: 345185 - DNA, 532 bp, Homo sapiens
  misc_feature: GZ8MTXP02IU7BH.15.8.A08.1.454.CMB.2.raw
  modified_base (168)..(168): a, c, t, g, unknown or other
  misc_feature (168)..(168): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
tcagtctacgtagccacgaccggtgctcgatttagcatactctacagggtggccggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaacagaacctggccagcctcccaggcctcctcatctatgctgcatccattaggcactggtatcccagccaggttcagtggcagtgggtctggcanagagttcacttcncaccatcagcngtccccgnagtctagaattntttgacttagtttatactgtacanataataataataagtagtactattactaccgttacgtaccgacggaacgaaagtagtatactacaaacgtaacgtagtagactcgacactactactcgtcttactacttacctcccgtcctactactacgtacgtacgtacgtacg

SEQ ID NO: 345186 - DNA, 581 bp, Homo sapiens
  misc_feature: GZ8MTXP02HTLI4.15.8.A08.1.454.CMB.2.raw
  modified_base (168)..(168): a, c, t, g, unknown or other
  misc_feature (168)..(168): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacacgtggtactccccagcccaggttcaggtggcaggttgggtctgggcacgagacgttcccactcctcaaccatccagccacgccccgnacgtctagaaagttntttgactagtttattactgtactagactaaatactaaacagtacgtacctatttacctaccgttttccggacccgtaacgggaaccctaaaggtacggaattaactaacgaaaaccgtaaacgtcgttacggctacgaccacctacttctacgttccttcctacttccttcccgactactctacgtacgtacgtaacg

SEQ ID NO: 345187 - DNA, 489 bp, Homo sapiens
  misc_feature: GZ8MTXP02HBEDC.15.8.A08.1.454.CMB.2.raw
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgcagtttagcctggtaccaacagaaacctggccagcctcccaggctcctcatctatgctgcatccattagggacactggtactcccagccaggttcagtggcagtgggtctggcacagngttccactctcaccatcagcacgcccgnagtctagaaagtatttgctagttattactgtcagacaatataacagtgactattcactttcgccagggaccaaagtgatagtacaaacgactgtgctgcacatctctcttcatctccgcctactctgacgtctaacg

SEQ ID NO: 345188 - DNA, 484 bp, Homo sapiens
  misc_feature: GZ8MTXP02I4R00.15.8.A08.1.454.CMB.2.raw
  modified_base (168)..(168): a, c, t, g, unknown or other
  misc_feature (168)..(168): n is a, c, g, or t
  modified_base (350)..(350): a, c, t, g, unknown or other
  misc_feature (350)..(350): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcagtggtctggcacagagttccactctcaccatcagcagcccgnagtctgaagattttgctagtttattactgtcagcaatataacagtgccattcactttcgcccagggaccaaagtgatatacaaacgaactgtaggctgacaccatctgtctcatctcccgcactctgagctacg

SEQ ID NO: 345189 - DNA, 513 bp, Homo sapiens
  misc_feature: GZ8MTXP02F7BFU.15.8.A08.1.454.CMB.2.raw
  modified_base (169)..(169): a, c, t, g, unknown or other
  misc_feature (169)..(169): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (493)..(493): a, c, t, g, unknown or other
  misc_feature (493)..(493): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttagcctggtaccaacagaaacctggccagcctcccaggctcctcatctatgctgcatccagttagggacactggtactcccagccaggttcaggtggcagggtgggtctggcacgagtcgttcccactctcaccatccagccacgccccganagtctagaaagttntttgcttagtttatactgtcagactaatataacagttgacctattcactttcgacccgagggaccaagtgatatacaacgactgcgctgcacatctcgtctcactccgttcccnctactctacgacgtactacg

SEQ ID NO: 345190 - DNA, 509 bp, Homo sapiens
  misc_feature: GZ8MTXP02ITG2P.15.8.A08.1.454.CMB.2.raw
  modified_base (355)..(355): a, c, t, g, unknown or other
  misc_feature (355)..(355): n is a, c, g, or t
  modified_base (476)..(476): a, c, t, g, unknown or other
  misc_feature (476)..(476): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctccctcatctatgctgcatccattagggacactggtactcccagccaggttcagtggcagtgggtctggcacagagttccactctcaccatcagcacgcccgnagtctgaaagtatttgactagtttatactgtcagcaaatataacagtgactaattaacttcggaccaagggaccaaagtgatatacaaaacgactgtagactcgacaccatcttctctacncttccctcccgctactcagacgtacgtacgtag

SEQ ID NO: 345191 - DNA, 500 bp, Homo sapiens
  misc_feature: GZ8MTXP02JMQEY.15.8.A08.1.454.CMB.2.raw
  modified_base (168)..(168): a, c, t, g, unknown or other
  misc_feature (168)..(168): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtactcccagccaggttcagtggcagtgggtctggcacagagttcccactctcaccatcagcacgcccgnagtctagaatntttgctagtttatactgtcagcaatataacagtgacattcacttcgcctagggaccaaagtggatatacaaacgaacgtgtaggctgacaccatctacgtcttcactccttcccgactactctacgacgctaacg

SEQ ID NO: 345192 - DNA, 541 bp, Homo sapiens
  misc_feature: GZ8MTXP02ILQJX.15.8.A08.1.454.CMB.2.raw
  modified_base (168)..(168): a, c, t, g, unknown or other
  misc_feature (168)..(168): n is a, c, g, or t
  modified_base (289)..(289): a, c, t, g, unknown or other
  misc_feature (289)..(289): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctcctcatctatgctgcatccattagggacactggtancccagccaggttcagtggcagtggtctggcacagacgttccactctcaccatcagcacgccccganagtctaggaaagttnttttgcttagtttatactgtcagcaatataacagtgacctattcaccgtttcgaccctagggaaccaagtggatatacgaaacgtaacgtgtacggtctcggaccacctaatcgtcgttaccttcctaacgttcccgttccccgacctacttccctagacgtcttaaacgg

SEQ ID NO: 345193 - DNA, 617 bp, Homo sapiens
  misc_feature: GZ8MTXP02FVV8J.15.8.A08.1.454.CMB.2.raw
  modified_base (168)..(168): a, c, t, g, unknown or other
  misc_feature (168)..(168): n is a, c, g, or t
  modified_base (417)..(417): a, c, t, g, unknown or other
  misc_feature (417)..(417): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcgagggcctagtcagagtagttcgccgcctagtttacgccgtaggtaaccaacgaacgaaacctcggacccacgccctcccgaggtcctcctacattctatcgctgcactccagttacgggactacgtggtactccgagccgtaggttcaggtcggactagggtcggtctggacacaggtacttccacctctacaacctatcagccgacgcccgatacgtctaaggaaagtttntttcgactttagtttacttacgtgtacacactaataactaacgtaacgtacgtactacttacttaccgttaccgtaccgaacggaacgtaacgtagtaacgtaactaacgaaacgtaacgtacgtacgtacgtacgacactactacgttacgttacttactactccgttcccgtacctactacgtacgtacgtacgtacg

SEQ ID NO: 345194 - DNA, 527 bp, Homo sapiens
  misc_feature: GZ8MTXP02F6VWL.15.8.A08.1.454.CMB.2.raw
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctatgctgcatccattagggacactggtatcccagccaggttcagtgcagtggtctggcacagagttccactctcaccatcagcacgcccgnagtctgaaagttntttgntagtttatactntcanacaataataacagtcgactattactacgttccgaccgacgggaactaaagtagataacgtaacgaaacgtacgtgtacgactcgacacctactctcgttaccttactactccgttcccgactactcgtacgacgtactaacg

SEQ ID NO: 345195 - DNA, 529 bp, Homo sapiens
  misc_feature: GZ8MTXP02JO9IL.15.8.A08.1.454.CMB.2.raw
  modified_base (256)..(256): a, c, t, g, unknown or other
  misc_feature (256)..(256): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctnatctatgctgcatccattagggacactggtatccagccaggttcagtgcagtgggtctggcacagagttccactctcaccatcagcacgcccgcagtctagaaagtatttgctagtttatactgtcagtaanaataataanagtacgtactactactacgtacgaccgacggaacgaagtagtataataacaaacgtaacgtagtagtacgtacgacactactactctactactactccgtcccgtacctactacgtacgtacgtacgtaacg

SEQ ID NO: 345196 - DNA, 567 bp, Homo sapiens
  misc_feature: GZ8MTXP02HHMY2.15.8.A08.1.454.CMB.2.raw
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggcctcctcatctatgctgcatccattagggacactggtactcccagccaggttcagtggcaggtgggtctggcacagtagttcccactctcaccatccagcacgcccnagtctagaaagtatttgctagtttatactgtnagtactaaataataacgaagtcgacctagtttacctacgtttccggaccctaaggggaaccctaaagtggaatataaccgaaaacgtaactggtacggtctacgaccacctagttccttcgttccttctaacttcccgtttaccccgaccctattcctacgacggttacttaaccgg

SEQ ID NO: 345197 - DNA, 531 bp, Homo sapiens
  misc_feature: GZ8MTXP02IEBPA.15.8.A08.1.454.CMB.2.raw
  modified_base (169)..(169): a, c, t, g, unknown or other
  misc_feature (169)..(169): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagtctacgtagccacgaccggtgctcgatttagcatactctacagggtggctggagactgcgtcatcactacttctcttcctcctgctactctggctccccagataccactggagaagtagtgatgacgcagtctccagccaccctgtctgtgtctccgggggaaanagccacccctctcctgcagggccagtcagagagttgccgccagtttacgcctggtaccaacagaaacctggccagccctcccaggcctccctcatctatgctgcatccagttagggactacgtggtactcccagccaggttcagtggcaggtgggtcnggcacagattccactctcacatcagcacgcccncagtctagaattntttgctagtttatactgtcagactaaataataacagtcgacctattacctacgtttccgacccgagggtaaccaaaggtacggaattacgtaacaaacgtacgtgtacggctagcacatctctcttcacttccttctactcctatcctagacgtaccg

SEQ ID NO: 345198 - DNA, 492 bp, Homo sapiens
  misc_feature: GZ8MTXP02JZTSP.15.8.A08.1.454.CMB.2.raw
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtcnggcanagagttccactctcaccatcagcagccccgnagtctgaaagtnttttgctagtttattactgtcagcaatataaacagtgaccattcactttcggccagggaccaaagtggatatcaaacgactgtggctgcaccatctgtcttcatccttcccgccatcctgacgctaacg

SEQ ID NO: 345199 - DNA, 529 bp, Homo sapiens
  misc_feature: GZ8MTXP02FX5VJ.15.8.A08.1.454.CMB.2.raw
  modified_base (168)..(168): a, c, t, g, unknown or other
  misc_feature (168)..(168): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcaggtggtctggcacagagttcccactctcaccatcagcacgcccgnagtctagaagtntttgctagtttattactgtctagactaataataaactaagtcgacctattctacgtttccgacccgtacgggaaccaaaggtggaatactacaaacgactgtggctgactaccatctcgttacttctacttccttccccgtactactctagtacgtcttaacgg

SEQ ID NO: 345200 - DNA, 499 bp, Homo sapiens
  misc_feature: GZ8MTXP02HQL3M.15.8.A08.1.454.CMB.2.raw
  modified_base (168)..(168): a, c, t, g, unknown or other
  misc_feature (168)..(168): n is a, c, g, or t
  modified_base (256)..(256): a, c, t, g, unknown or other
  misc_feature (256)..(256): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctnatctatgctgcatccattagggcactggtatcccagccaggttcagtggcagtgggtctggcacagagttccactctcaccatccagccagcccgnagtctagaagtntttgctagttatactgtcagcaatataacagtgactattcacgtttcgcctagggaccaagtgatatacaaacgtaactgtaggtctgcacctatctcgtacttcactcctcccgtcctactctgacgtctaacg

SEQ ID NO: 345201 - DNA, 574 bp, Homo sapiens
  misc_feature: GZ8MTXP02HO8OB.15.8.A08.1.454.CMB.2.raw
  modified_base (168)..(168): a, c, t, g, unknown or other
  misc_feature (168)..(168): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggctcctcatctatgctgcatccattacgggactacgtggtactcccagccaggttcagtgcaggttgggtctggcacagtacgttcccactctcaccatccagcacgccccntagtctaggaacttatttgacttagtttattactgttacagactagtaattagtagttacctcggtaggtacggttcggacgtaagggaccgaaaggtcgaaaatacgaaaacgtactaggtaggactcggtaccaacctattctacgttcttacacgtttcccttacccgcctaacgtacggtacgttaccgtagtaccgttaggtacggg

SEQ ID NO: 345202 - DNA, 587 bp, Homo sapiens
  misc_feature: GZ8MTXP02HG1W6.15.8.A08.1.454.CMB.2.raw
  modified_base (168)..(168): a, c, t, g, unknown or other
  misc_feature (168)..(168): n is a, c, g, or t
  modified_base (257)..(257): a, c, t, g, unknown or other
  misc_feature (257)..(257): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttacgcctggtaccaacagaaacctggccagccctccaggcctccnatcatgctgcatccaagttagggacacgtggtactcccagccaggttcagtggcagtggtctggcacgngattccactctcaccatcagccacgccccganagtctaggaattagtttgtactagtttattacgtgtactagtacaataataaacagtacgtacctattacctacgtttccggacccgaacgggaacccgtaaaggtggtaataacgtaacgtaaacgtaacgtaggtacggtacctacggtaccaacccgtaattccgttacgttccttacctacttcccttccccggacctacttccgtacgacgttacgttaaccgg

SEQ ID NO: 345203 - DNA, 501 bp, Homo sapiens
  misc_feature: GZ8MTXP02HAIXR.15.8.A08.1.454.CMB.2.raw
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctatgctgcatccattaggacactggatcccagccaggttcagtggcaggtgggtctggcacagngttccactctcaccatcagcagcccgnagtctagaagtntttgctagtttatactgtcagcaatataacagtcgacctattctactttcgaccagggaaccaaagtgaatatacaaacgactgtagctgacaccatctcgtcttcactccttccgacctatcctagacgtactaacg

SEQ ID NO: 345204 - DNA, 570 bp, Homo sapiens
  misc_feature: GZ8MTXP02G400S.15.8.A08.1.454.CMB.2.raw
  modified_base (168)..(168): a, c, t, g, unknown or other
  misc_feature (168)..(168): n is a, c, g, or t
  modified_base (391)..(391): a, c, t, g, unknown or other
  misc_feature (391)..(391): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggcctcctcatctatgctgcatccagttagggacacgtggtactcccagccaggttcaggtggcaggttcggggtctgggacacgagtacgtttcccacttcctacaccatccagccacggcccgacagtctagaaacgttntttgcttagtttattactgtcagactaataataaacaagtgacctattacctacgtttccggacccgacgggaaccaaaggtaggtaataactacaaacgtaacgtgtacggtctacgacacctatccttcgtcttactacttccgttcccgacctactccgtacgacgtacgttaacg

SEQ ID NO: 345205 - DNA, 749 bp, Homo sapiens
  misc_feature: GZ8MTXP02HU229.15.8.A08.1.454.CMB.2.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcagtttagcctggtaccaacagaaacctggccagcctccagctccnatctangctgcatccagttagggacactggtactcccagccaggttcagtggcaggtgggtctggcacgagtagtttccccacttcctacaacctatccgaagcccaacggccccccgtacgtaacggttcctagggtaaaacgtttagtttttacgtacgttaacggtttttaactttacgttacgttaccgtaacggtaacctaaaagtttaaacgttaaaaccgtaaaggttacgggtacccttaacgttttaccttaacccggttttttaccccgggaacccccggtaaaccgggggaaaaccccgtaaaagggttaacgggtaaacttaaacgttaaaccaaaaccggtaaaccgttaggtacggtaccgtacggtacccaaacccgttaaacgttaccttaccggtttacctttaccgttaaccgtttccccgtttacccccgtacccgttaccttaccgttacggtaaccggttacccgtttaaaccgg

SEQ ID NO: 345206 - DNA, 582 bp, Homo sapiens
  misc_feature: GZ8MTXP02HYZL7.15.8.A08.1.454.CMB.2.raw
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (337)..(338): a, c, t, g, unknown or other
  misc_feature (337)..(338): n is a, c, g, or t
  modified_base (350)..(350): a, c, t, g, unknown or other
  misc_feature (350)..(350): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaanagaaacctggccagccctcccaggctcctcatctatgctgcatccagttagggacactggtactcccagccaggttcagtggcagtggtcnggacangntccactcncacnncgagcacgcccntagtcagtaagttctttgacttagtttacttacgtgtacacgtactaataataaacgtaagtacgtactacttacttacgtttaccggtacccggacgggtaaccgtaaacgtagtaagtaacgtaacgaaacgtaaacgtacgtacggtacgtacgaccaacctacttacgttacgttaccttacctaccttcccgttacccgtacctactacgtacgtacgtacgtaacg

SEQ ID NO: 345207 - DNA, 518 bp, Homo sapiens
  misc_feature: GZ8MTXP02JX8JD.15.8.A08.1.454.CMB.2.raw
  modified_base (168)..(168): a, c, t, g, unknown or other
  misc_feature (168)..(168): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (499)..(499): a, c, t, g, unknown or other
  misc_feature (499)..(499): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctcctcatctatgctgcatccattagggacactggtactcccagccaggttcagtggcaggtgggtctggcacgagtagttcccactctcaccatcagcacgcccgnagtcngaaatntttgctagtttattactgtcagacaataataacagtggacctattcctacgtttcggacccgtaggggaaccaaagtggaatagtacaaacgactggagctgacaccatctacgtcttcactccgtcccnctactctcgacgtctaacg

SEQ ID NO: 345208 - DNA, 509 bp, Homo sapiens
  misc_feature: GZ8MTXP02IPVS3.15.8.A08.1.454.CMB.2.raw
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagcctcccaggctcctcatctatgctgcatccattagggacactggtactcccagccaggttcagtggcagtgggtcnggcacagagttccactctcaccatcagcagcccnatcngaatntttgctagtttatactgtcagtacaaatataaacagtggacctattccacgtttcgacccgagggaaccaaagtcggataatacaaacgactgtaggctgacactatctcgtcttcacttccttccgactactctcgacgtactaacg

SEQ ID NO: 345209 - DNA, 498 bp, Homo sapiens
  misc_feature: GZ8MTXP02GDVOD.15.8.A08.1.454.CMB.2.raw
  modified_base (354)..(354): a, c, t, g, unknown or other
  misc_feature (354)..(354): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtactcccagccaggttcagtggcaggtgggtctggcacagagttccactctcaccatcagcacgcccgnagtctagaagtatttgctagtttatactgtcagcaatataacagtgaccattctacttcgacccgagggaccaagtgatatacaaacgactgtggctgcacatctacgtctcactccgttcccactactctacgacgtactacg

SEQ ID NO: 345210 - DNA, 569 bp, Homo sapiens
  misc_feature: GZ8MTXP02IGGFO.15.8.A08.1.454.CMB.2.raw
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctctcatctatgctgcatccattagggacacgtggtactccagccaggttcagtggcagtgggtctggcacgagagttccactctcacatcagcacgcccgnagtctagaaagtntttgctagtttattactgtcagacaatataaacagtcggactattctacgtttccggacccgaacgggaaccgaaaggtaggaataactaacaaacgtaacgtagtacggccgtagccaacctaacgtaccgtttacgttacctttactaccttcccgttaccccgtaccttaccttaccgttacggtaacgtacgttaacgg

SEQ ID NO: 345211 - DNA, 487 bp, Homo sapiens
  misc_feature: GZ8MTXP02GI0ND.15.8.A08.1.454.CMB.2.raw
  modified_base (168)..(168): a, c, t, g, unknown or other
  misc_feature (168)..(168): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggctcctcatctatgctgcatccattagggacactggtatcccagccaggttcagtggcagtggtctggcanagagttccactctcaccatccagcagcccgnagtcngaaagttnttgntattatatntnanacatanaacagtgactatctacgttcgacgaggacaagtgatanacaacgagtgngacngacacatctcgtcttcactcctccgactactctacgacgtactacg

SEQ ID NO: 345212 - DNA, 533 bp, Homo sapiens
  misc_feature: GZ8MTXP02HVBTK.15.8.A08.1.454.CMB.2.raw
  modified_base (169)..(169): a, c, t, g, unknown or other
  misc_feature (169)..(169): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcagtttagcctggtaccaacagaaacctggccagccctcccaggctcctcatctatgctgcatccagttagggacacgtggtactcccagccaggttcaggtggcaggtgggtctgggacacgagacgttcccactctacaccatccagccagcccnagtctagaaatntttgctagtttatactgtcagctagttattatagtactcggtaggtacgttcggaccgaaagggaccaaagggtagaaatacgaaaacgactggtagctagcacctatctcgtcttacacttcctcccgcctagtacgacgtacgtagacgtggagg

SEQ ID NO: 345213 - DNA, 547 bp, Homo sapiens
  misc_feature: GZ8MTXP02HPOSL.15.8.A08.1.454.CMB.2.raw
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctatgctgcatccattagggacactggtactcccagccaggttcagtggcaggtgggtctggcacgagagttccactctcaccatccagccagcccgnagtctagaaatntttgctagtttattactgtcagtacaataactaacgagtcggacctagtttcctaaccgttttccgggaccccgaacggggtaacctaaaaggtggaataacgtacgaaaacgacgtgtacggctgacaccatctcgtcttcactcccgttccgacctactctacggactcgttaacg

SEQ ID NO: 345214 - DNA, 567 bp, Homo sapiens
  misc_feature: GZ8MTXP02JNJ1M.15.8.A08.1.454.CMB.2.raw
  modified_base (168)..(168): a, c, t, g, unknown or other
  misc_feature (168)..(168): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtactcccagccaggttcagtggcagtgggtctggcacagagttccactctcaccatcagcagcccganagtctgaaagttntttgacttagtttatacgtgtacagactaataataacgtacgtacgtactacttactacgttaccggtacccggacgggaaccgtaaacggtaggtacgtacgtaacgtaaacgtaacgtagtacggtacgtacgaccacctactacttcgttaccttactacttccgttcccgtacctactacgtacgtacgtacgtacg

SEQ ID NO: 345215 - DNA, 528 bp, Homo sapiens
  misc_feature: GZ8MTXP02HF58P.15.8.A08.1.454.CMB.2.raw
  modified_base (167)..(167): a, c, t, g, unknown or other
  misc_feature (167)..(167): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtctccgggggaaanagccaccctctcctgcagggccagtcagagagttgccgccagtttagcctggtaccaacagaaacctggccagcctccaggctcctcatctatgctgcatccagttagggactacgtggtactcccagccaggttcagtggcaggtgggtctggcacgagtacgttccactcctcaccatcagcacgccccgnagtctagaagttatttgctagtttatactgtcagtacaatactaacgagtcgacctattccacgtttccgaccgagggaccaagtgaatatacaaacgtactagtacgtctcgactacacttctcgtacttctactccttcccgactacgtctacgtacgtactaacg

SEQ ID NO: 345216 - DNA, 551 bp, Homo sapiens
  misc_feature: GZ8MTXP02HPIUY.15.8.A08.1.454.CMB.2.raw
  modified_base (169)..(169): a, c, t, g, unknown or other
  misc_feature (169)..(169): n is a, c, g, or t
  modified_base (254)..(254): a, c, t, g, unknown or other
  misc_feature (254)..(254): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcagtttagcctggtaccaacagaaacctggccagcctccaggctccnatcatgctgcatccattagggacacgtggtactcccagccaggttcagtggcagggtgggtctggcaacgaggtacgttccactctacaccatcagcacgcccgnagtctagaaattntttgactagtttatactgtcagactaaataataaacaagtcgacctattactacgtttccggaccgaagggaacctaaaggtaggaataacgtaacgaaaacgtaactaggtaggacctggaccaccatccttgtccttacacttcccgttccccactactcctagtacgtactaacgg

SEQ ID NO: 345217 - DNA, 582 bp, Homo sapiens
  misc_feature: GZ8MTXP02HHCCE.15.8.A08.1.454.CMB.2.raw
  modified_base (168)..(168): a, c, t, g, unknown or other
  misc_feature (168)..(168): n is a, c, g, or t
  modified_base (326)..(326): a, c, t, g, unknown or other
  misc_feature (326)..(326): n is a, c, g, or t
  modified_base (560)..(560): a, c, t, g, unknown or other
  misc_feature (560)..(560): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgcagtttagcctggtaaccaacagaaacctggccagccctcccaggcctcctcatctatgctgcatccaagttagggacacgtggtactcccgagccaggttcaggtggctagggtgggtcnggcacagtagttcccactctcaccatcagccacgcccgactagtctaggaaagttatttgtacttagtttattacgtgtacagtacaaattaataaacgaagtcggacctatttacctacgtttaccggacccgtaacggggaaccctaaaggtaggtaacttaacgtaacgtaaaacgtaacgtggtacggtactcgaccacctattcttacgttccttctactccgttcccnctactcgtacgtacgtactacg

SEQ ID NO: 345218 - DNA, 515 bp, Homo sapiens
  misc_feature: GZ8MTXP02GF3UL.15.8.A08.1.454.CMB.2.raw
  modified_base (325)..(325): a, c, t, g, unknown or other
  misc_feature (325)..(325): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (439)..(439): a, c, t, g, unknown or other
  misc_feature (439)..(439): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggcctcctcatctatgctgcatccattagggacactggtactcccagccaggttcagtggcaggtgggtctggcanagtgttccactctcaccatcagccagccccgnagtctagaaagtntttgctagtttattactgtctagacaatataacaagtgactattctactttcggacccagggaccaagnggataatacaaacgaactgtaggctgcacctatctcgtcttcacttccgtccctactactctacgtacgcttaacg

SEQ ID NO: 345219 - DNA, 558 bp, Homo sapiens
  misc_feature: GZ8MTXP02FQNI0.15.8.A08.1.454.CMB.2.raw
  modified_base (168)..(168): a, c, t, g, unknown or other
  misc_feature (168)..(168): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccagttagggacactggtactccagccaggttcaggtggcaggtgggtctggcacagattcccactctcaccatcagcacgcccgtnagtctaggaaatntttgcttagtttattactgtcagactaaataactaaacaagtcgacctattacctaccgtttccggacccgaaggggaacctaaaggtgaatactaacaaacgtaacgtgtacggactcgacctacctactcgttcgttaccttctaacgttcccgttcccgacctacttcctagtacgtactaaacgg

SEQ ID NO: 345220 - DNA, 591 bp, Homo sapiens
  misc_feature: GZ8MTXP02H4ZYG.15.8.A08.1.454.CMB.2.raw
  modified_base (168)..(168): a, c, t, g, unknown or other
  misc_feature (168)..(168): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcaggccagtcagagagttgccgccagtttagcctggtaaccaacagaaacctggccagcctccaggcctcctcatctatgctgcatccagttagggacactggtactcccagccaggttcaggtggcaggtgggtctggcacgagagttccactctcaccatccagcacgcccnagtctgaactntttcgactagtttattactgtctagacaatataacagtagactattctacgtttacggacccgagggaaccgtaaagtacggaataacgtacgtaaaacgtaacgtcgtacggtacgtacggtacctaacctacttaccgttacgttcctttaccgttaaccgttcccctttaccccggtaccttaacgttcctttaccggaacgttacccgtttaaaccggg

SEQ ID NO: 345221 - DNA, 574 bp, Homo sapiens
  misc_feature: GZ8MTXP02I9LSZ.15.8.A08.1.454.CMB.2.raw
  modified_base (169)..(169): a, c, t, g, unknown or other
  misc_feature (169)..(169): n is a, c, g, or t
  modified_base (229)..(229): a, c, t, g, unknown or other
  misc_feature (229)..(229): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttagcctggtaccaanagaaacctggccagcctccagctctcatctatgctgcatccattagggacacgtggtactcccagccaggttcaggtggcaggtggggtctggcacgagtacgttccacctctacacccatccagcacgccccganagtctagaaacgtttntttgacttagtttacttacgtgtacagtactaaataataaacgagtacgtacctacttacctaccgttccggacccgacgggaaccaaaggtaggtaataactaacgaaacgtacgtagtcgtactcgaccactacttcgttcgttaccttactactcccgttcccgactactacgtacgtacgtacgtaacg

SEQ ID NO: 345222 - DNA, 509 bp, Homo sapiens
  misc_feature: GZ8MTXP02JOXUP.15.8.A08.1.454.CMB.2.raw
  modified_base (168)..(168): a, c, t, g, unknown or other
  misc_feature (168)..(168): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (455)..(455): a, c, t, g, unknown or other
  misc_feature (455)..(455): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattacgggacactggtactcccagccaggttcagtggcagtggtctggcacaggattccactcncaccatcagcagcccgnagtcagaatntttgctagtttatactgtcagacaataataacagtcgacattcactttcgacccagggaaccaaagtgaatatacgaaacgtacgtgtcgacncgactactatctcgtctactactcccgtccactactcgtacgtacgtacgtacg

SEQ ID NO: 345223 - DNA, 519 bp, Homo sapiens
  misc_feature: GZ8MTXP02JDJPC.15.8.A08.1.454.CMB.2.raw
  modified_base (168)..(168): a, c, t, g, unknown or other
  misc_feature (168)..(168): n is a, c, g, or t
  modified_base (227)..(227): a, c, t, g, unknown or other
  misc_feature (227)..(227): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (485)..(485): a, c, t, g, unknown or other
  misc_feature (485)..(485): n is a, c, g, or t
  modified_base (499)..(499): a, c, t, g, unknown or other
  misc_feature (499)..(499): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaanagaaacctggccagcctccaggctcctcatctatgctgcatccattaggacactggtatccagccaggttcagtggcagtggtctggcacagagttccactctcaccatcagcagccccgnagtctagatntttcgctagtttatactgtcagacaataataacgagtcgacctattacctacgtttaccggacccgtaacgggaacctaaaggtcgaatacgtaacgaaacgaactgtacgctacgacactattctntctctactcgtccncctactctcgacgtactacg

SEQ ID NO: 345224 - DNA, 726 bp, Homo sapiens
  misc_feature: GZ8MTXP02GUJNZ.15.8.A08.1.454.CMB.2.raw
  modified_base (263)..(263): a, c, t, g, unknown or other
  misc_feature (263)..(263): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttcgccgcctagtttagcctaggtaaccaacagaaacctggccacgcctcccaggcctcctnatctatgctgcatccaagttacgggacacgtggtactcccagccaggttcaggtggcaggtggtactggacacagtacgttccactctacaccatccaacgcctaacggccccgacgtagtactaggtaaattagtttttacgaccttaaggttttaacttactaggttaacccaaagtaacctaaaatttaaacgtaaaaccgtaaaggttccggtaaacccttaactttacccgttaaacccgggttttacccggggaacccccggttaaaagggggaaaacccctaaaagggtttaggaaacgtttaactaaaccgaaaaacggtaaccgtttgggtaaccggacttaccggaaccttaaccctaagtttccgttcgtttaccttacccttaaaccgttcccccgtttacccccgaaaccttcggttacctaacggtaaccggttaccgttaaaaccggg

SEQ ID NO: 345225 - DNA, 590 bp, Homo sapiens
  misc_feature: GZ8MTXP02ILN67.15.8.A08.1.454.CMB.2.raw
  modified_base (168)..(168): a, c, t, g, unknown or other
  misc_feature (168)..(168): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcagtttagcctggtaccaacagaaacctggccagccctcccaggctcctcatctatgctgcatccattaggacactggtacnccagcagtcngtgcngtggtcngcanagtntccactctacacatcagcgacgcccgtactagtctagaaagtttntttacgacttaagttttacttacgttagtacaagtaactaaataaactaaacgtaagtacgtacctacttaccgttacgtttaccggtaccgtaacggaaacgtaaacgtaagtaagtaacgtaacgtaaaacgtaaacgtagtacggtacgtacgaccacctacttacgttacgttacttactacttcccgttacccgtacctactacgtacgtacgtacgtaacg

SEQ ID NO: 345226 - DNA, 532 bp, Homo sapiens
  misc_feature: GZ8MTXP02JZQ4J.15.8.A08.1.454.CMB.2.raw
  modified_base (256)..(256): a, c, t, g, unknown or other
  misc_feature (256)..(256): n is a, c, g, or t
  modified_base (365)..(365): a, c, t, g, unknown or other
  misc_feature (365)..(365): n is a, c, g, or t
  modified_base (483)..(483): a, c, t, g, unknown or other
  misc_feature (483)..(483): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctaggtaccaacagaaacctggccagcctccaggctccncatcatgctgcatccattagggacactggtactcccagccaggttcaggtggcaggtgggtctggctacgagtacgttcccactctacacctatccagccacgccccgnagtctagaaagtctttgactagtttattactgtactagactaataataacgagtcgactattcacgttcgaccagggaccaagtgatatacaaacgtacgtgacggctcgacaacctntctcgttcctactacttcccgttccactacttacgacgacgtacgtacg

SEQ ID NO: 345227 - DNA, 541 bp, Homo sapiens
  misc_feature: GZ8MTXP02HOYHP.15.8.A08.1.454.CMB.2.raw
  modified_base (168)..(168): a, c, t, g, unknown or other
  misc_feature (168)..(168): n is a, c, g, or t
  modified_base (324)..(324): a, c, t, g, unknown or other
  misc_feature (324)..(324): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctctcatctatgctgcatccattagggacactggtactcccagccaggttcagtggcagtgggtctggcacagnttccactctcaccatcagcacgcccnagtcngaattnttgctagtttattactgtcagacaataataacagtcgacctacttactacgtttccggaccgaacgggaaccgtaaagtaggataactacgaaacgtaacgtagtacggtcgtcgaccacctacttacttcgttcttactacttcccgttcccgacctactcgtacgtacgtacgtaacg

SEQ ID NO: 345228 - DNA, 489 bp, Homo sapiens
  misc_feature: GZ8MTXP02FS4G2.15.8.A08.1.454.CMB.2.raw
  modified_base (168)..(168): a, c, t, g, unknown or other
  misc_feature (168)..(168): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaacagaaacctggccagccctcccaggcctcctcatctatgctgcatccattagggacactggtactcccagccaggttcagtggcaggtgggtctggcacgagtagttccactcncaccatcagcagcccgnagtctagaatntttgctagtttatactgtcagcaatataacagtcgacattcacttcgccagggaccaagtgatatacaaacgactgtgactgacaccatctgtacttcatccgttccnctatctganctacg

SEQ ID NO: 345229 - DNA, 532 bp, Homo sapiens
  misc_feature: GZ8MTXP02G3O5W.15.8.A08.1.454.CMB.2.raw
  modified_base (169)..(169): a, c, t, g, unknown or other
  misc_feature (169)..(169): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttacgcctggtaccaacagaaacctggcccagccctcccaggcctcctcatcatgctgcatccagttaggacagtggtactcccagcctaggttcagtggctaggtgggtctggacacgtaggtactcccactcctacaccatccagctacgcccgcagtctagaatntttgactagtttatactntcaanactaataactaacgagtacgactacttactacgttccgaccgacggaacgtaagtagataagtaacaacgtagtgtcgtacacactactatctctctctactcctccactactctacgtacgtactacg

SEQ ID NO: 345230 - DNA, 539 bp, Homo sapiens
  misc_feature: GZ8MTXP02HVXM2.15.8.A08.1.454.CMB.2.raw
  modified_base (179)..(179): a, c, t, g, unknown or other
  misc_feature (179)..(179): n is a, c, g, or t
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctntcctgcaggccagtcagagagttgccgcagtttagcctggtaccaanagaaacctggcagcctccaggctcnatnangcngcatcagtaggacacgtgacnccagcagtnagtgcaggtggcngacagtagacttccactctacacatcagcacgcgacgacgtntagagtattatatattattactagtanaganaataataaacgtaagtacgactacttactacgttaccgtaccgaacggaacgaaagtagtaagtaacgtaacgaaacgtaacgtagtacgtacgtacgaccactactactacgtacttactacttaaccgttcccgtacctactacgtacgtacgtacgtaacg

SEQ ID NO: 345231 - DNA, 498 bp, Homo sapiens
  misc_feature: GZ8MTXP02IFP9I.15.8.A08.1.454.CMB.2.raw
  modified_base (168)..(168): a, c, t, g, unknown or other
  misc_feature (168)..(168): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (373)..(374): a, c, t, g, unknown or other
  misc_feature (373)..(374): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaacctggccagccctcccaggcctcctcatctatgctgcatccattagggacacgtggtactcccagcccaggttcaggtggcaggtggggtctggcacagtagtccactctcaccatcagcacgcccgnagtcngaattnttnntattatntgtnanataatanaagagtgactattctacgttcgacgaggacgagtagatanacaagagtgngctgcactactctcgtcttctacttccgtccactactcgtacgacgtacgtacg

SEQ ID NO: 345232 - DNA, 651 bp, Homo sapiens
  misc_feature: GZ8MTXP02FW11W.15.8.A08.1.454.CMB.2.raw
  modified_base (169)..(169): a, c, t, g, unknown or other
  misc_feature (169)..(169): n is a, c, g, or t
  modified_base (258)..(258): a, c, t, g, unknown or other
  misc_feature (258)..(258): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttagcctggtaaccaacagaaacctggccagcctccaggctccctnatctatgctgcatccagttacgggacagtggtactccccagccaggttcagtggcaggtggtctggcacagtagttcccactctcaccatcagccacgcccgcagttctaggtaaagttattttgacgttaagttttacttacgttagttacgaacgtactaaattaacgttaaaccgtaagtcggacccttatttaccgtaacccgttttccggaccccgtaaacggggtaaaccccgtaaagggttacgggtaattaacgttaacgaaaaccgtaaacgttcgtaacggggtcttacggaccctaacgtacgttccttacgttccctttacctaacgtttccccttaccccggtacctaacttccgtttacgaacggtacctttaaaccgg

SEQ ID NO: 345233 - DNA, 541 bp, Homo sapiens
  misc_feature: GZ8MTXP02JVPEW.15.8.A08.1.454.CMB.2.raw
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcaggccagtcagagagttgccgccagtttagcctggtaccaacagaaacctggccagcctcccaggcctcctcatctatgctgcatccagttagggacacgtggtactcccagccaggttcagtggcaggtgggtctggcacagtacgttcccactctcaccatccagccacgcccgntagtctagaagtntttgctagtttatactgtcanacaatanaacagtcgtactattcctacgtttccggacccaacgggaaccaaaggtggaactagtaacaaacgtaacgtggtacgtctacgaccactatcgttctcttctactccttccccgactacgtctacgacgtacgtaacg

SEQ ID NO: 345234 - DNA, 548 bp, Homo sapiens
  misc_feature: GZ8MTXP02FP6OH.15.8.A08.1.454.CMB.2.raw
  modified_base (168)..(168): a, c, t, g, unknown or other
  misc_feature (168)..(168): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaacagaaacctggcccagccctcccaggctcctcatctatgctgcatccagttagggacactggtactcccagccaggttcaggtggctaggtggtctggcacgagtagttcccactcctcaccatcagcacgtccccgnacgtctaggaaatntttgctagtttatactgtacagactaaataactaacaagtcggacctattctacgtttccggaccctagggaacctaaaggtgatactaacaaacgacgtgtacggtctcgactaccattctcgttaccttctactcccgttaccccgctactcgtacgacgtacgtaacg

SEQ ID NO: 345235 - DNA, 607 bp, Homo sapiens
  misc_feature: GZ8MTXP02JBU03.15.8.A08.1.454.CMB.2.raw
  modified_base (376)..(376): a, c, t, g, unknown or other
  misc_feature (376)..(376): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagcctcccaggctccctcatctatgctgcatccattacgggacacgtggtactcccagccaggttcagtggcaggtgggtctggcacgagtacgttccacctctcaccatcagccacgcccgcagtctagaacgtntttgcttagtttacttactgtacagactaaataactaaacgaagtacggtactaacgttacctaccggtttacccggaccccggtaacgggtaaacccgtaaaggtacggtaacttaacgtaaccgaaaacgtaaacgtggtacggtacgtacgaccaaccgtacgttacttacgttccttacctaacttcccgttcccgtacctacgtcgtacgtacgtaccgttaacgg

SEQ ID NO: 345236 - DNA, 592 bp, Homo sapiens
  misc_feature: GZ8MTXP02I1QBH.15.8.A08.1.454.CMB.2.raw
  modified_base (371)..(371): a, c, t, g, unknown or other
  misc_feature (371)..(371): n is a, c, g, or t
  modified_base (386)..(386): a, c, t, g, unknown or other
  misc_feature (386)..(386): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgctagtttagcctggtaccaacagaaacctggccagcctccaggcctcctcatctatgctgcatccagttacgggactacgtggtactcccgagcccaggttccaggtggctagggtgggtctggcacaggtagttcccactctacacctatcagccacgcccgnacgtctagaaagttntttgcttagtttattactgtacagctaaataataaacaagtcgtacctacttctaccgtttaccggacccgagggaaaccgaaaggtaggaactaacgtaacaaaacggtaacgtagtcgtcgtacgacctaccacgttccgtacgttaccttacctactttcccgttaccccgacctacttaccgtacgtacgtaccgttaacgg

SEQ ID NO: 345237 - DNA, 500 bp, Homo sapiens
  misc_feature: GZ8MTXP02GM3DY.15.8.A08.1.454.CMB.2.raw
  modified_base (168)..(168): a, c, t, g, unknown or other
  misc_feature (168)..(168): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccagttagggacactggtactcccagccaggttcagtggcagtgggtctggcacagnttccactcncaccatcagcagcccgnagtctagaatntttgctagttattactgtcagactaatataacagtgacctattcacgtttcggaccctagggaccaaagtgaatatacaaacgaactgtcggctcgacacatctctctcactcctcccgctactctagacgtctaacg

SEQ ID NO: 345238 - DNA, 588 bp, Homo sapiens
  misc_feature: GZ8MTXP02HCCT7.15.8.A08.1.454.CMB.2.raw
  modified_base (260)..(260): a, c, t, g, unknown or other
  misc_feature (260)..(260): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggggaaagacgcccaccctctcctgcagggccagtcagagagttgccgccagtttagcctggtaaccaacagaaacctggccagcctccaggctcctnatcatgctgcatccagttagggacactggtactccgagccaggttcaggtggcaggtcgggtctggacacgaggtacttccactcncaccgatccagccacgtcccganacgtctagaaagtattttgactagtttatacgtgtcagactaaataactaaacgaagttcggacctatttcctaccgtttaccggacccgaacgggaaaccgaaagttaggaataactaacgaaaacgtaaactgtaggcctacggaccaaaccttactacgttcgttaccttactaccgttcccttacccgacctacgtcgtacgtacgtacgtaacg

SEQ ID NO: 345239 - DNA, 515 bp, Homo sapiens
  misc_feature: GZ8MTXP02FUD35.15.8.A08.1.454.CMB.2.raw
  modified_base (168)..(168): a, c, t, g, unknown or other
  misc_feature (168)..(168): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtatcccagccaggttcagtggcaggtgggtctggcacagtcgttccactctacaccatcagcagcccgnagtctagaacgtntttgctagtttatactgtcagactaatataacaagtcgacctattctactttccggacccagggaaccaaagtggaatatacaaacgaacgtgtacggctgacacctatctcgtctctactccttcccgactactctacgactctaac

SEQ ID NO: 345240 - DNA, 611 bp, Homo sapiens
  misc_feature: GZ8MTXP02IB4Z1.15.8.A08.1.454.CMB.2.raw
  modified_base (168)..(168): a, c, t, g, unknown or other
  misc_feature (168)..(168): n is a, c, g, or t
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtgactggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctccncatctatgctgcatccagttagggacacgtgtactccccagcctaggttcagtggctagggtgggtctggacacgagtagttcccactctcacctatcagccacgcccanagtctagattatttcgactagtttatacgtgtacagtactaaataactaaacgagtcgacctatttaccgtacgtttccggacccgtaagggtaaccctaaaggtcggtaacttaacgtaaccgtaaaacgtaacgttcggtacggtactacggtacctaccttaacgttccttacgttcctttactaccgtttccccgtttaccccgaccttacttccgtacggtaacgttaccgttaaaccgg

SEQ ID NO: 345241 - DNA, 610 bp, Homo sapiens
  misc_feature: GZ8MTXP02JSX0U.15.8.A08.1.454.CMB.2.raw
  modified_base (168)..(168): a, c, t, g, unknown or other
  misc_feature (168)..(168): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctcctcatctatgctgcatccattagggacactggtactcccagccaggttcaggtggcaggtgggtctggcacgagacgttcccactctcaccatcagccagcccgnagtctagaagtntttgactagtttattactgtcagctaaatataacgaagtcgacctatttacctaccgtttccggaccccgtaagggggaaaccctaaaggtacggtaattaaacgttaacgaaaaccgtaacgttcggtacgggtaccgttacggacccaacccgtaattccgttacgttaccctttacctaacgttcccctttacccccggacctaacgttccgtacggtaacgtaccgttaaaccgg

SEQ ID NO: 345242 - DNA, 692 bp, Homo sapiens
  misc_feature: GZ8MTXP02G6DK0.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccgaggctcctcatctatgctgcatccattagggacacgtggtactcccagccaggttcagtggcaggtgggtctggacacgagtacgttccactctacaccgatccgaagccacgccccgacacgttctaggtaagttacgttttgaccttaagttttattaccgttggttaccaagtacctaaataaactaaacgtaaacggttacggtaccctaactttaccgtaacccgttttaccgggaccccggaacggggtaaaacccgtaaaacggttagggtaaactttaacgaaaccgtaaaaccggtaaacgttcggtacgggtactttacggaacctaaccccgttaaattacccgtttcgtttaacccttccttaaacccgttcccttttaacccccggaccttaaacgttccctttacgggaaccgtacctttaaacccggg

SEQ ID NO: 345243 - DNA, 614 bp, Homo sapiens
  misc_feature: GZ8MTXP02IAMY9.15.8.A08.1.454.CMB.2.raw
  modified_base (255)..(255): a, c, t, g, unknown or other
  misc_feature (255)..(255): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcgaggccagtcagagagttgccgccagtttagcctggtaccaacagaaacctggccagcctccaggcctccncatctatgctgcatccagttaggacacgtggtactcccagccgaggttcgagtggctaggtggtctggcacgagtagttcccactctaccaccatcagcacgcccntagtctagattntttcgtctagtttacttatggtacacgtactaaattaataaacgtagtacggtaccttactttaccgtaccgttttaccggacccgtaacgggaaacccgtaaaggtaacggtaattaacgaaacgtaaaacgtaaccgtaggttacggtacacggtaccaacgtacgttaccgttacgtccctttactaaccgttcccgttaaccccgtcctacttcgtacgtacgttaccgttaaccgg

SEQ ID NO: 345244 - DNA, 578 bp, Homo sapiens
  misc_feature: GZ8MTXP02I6DXV.15.8.A08.1.454.CMB.2.raw
  modified_base (169)..(169): a, c, t, g, unknown or other
  misc_feature (169)..(169): n is a, c, g, or t
  modified_base (292)..(292): a, c, t, g, unknown or other
  misc_feature (292)..(292): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgctagtttagcctggtaccaacagaaacctggccagcctcccaggctcctcatctatgctgcatccattagggacactggtacncccagccaggttcagtggctaggtgggtctggcacgagtcgttcccactcctacacctatcagcacgcccganagtctagaaagttntttgcttaagtttactacgtgtacagtactaaattaactaaacgagtcggacctattctaaccgtttccggaccccgtaagggaaccctaaaggtggaacttaacgtaacgaaaacgtaacgtgtaggtctgacctaccgtatcgtcgttacttctacttcccgtaccccgtactacttcgtacgacgtacttaaacgg

SEQ ID NO: 345245 - DNA, 512 bp, Homo sapiens
  misc_feature: GZ8MTXP02JZV58.15.8.A08.1.454.CMB.2.raw
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggccagcctcccaggctcctcatctatgctgcatccattagggacactggtactcccagccaggttcagtggcaggtgggtctggcacagtacgttccactctcaccatcagcacgcccgnagtctagaagtntttgctagtttattactgtcagactaataataacaagtgacctattccacgtttcgaccagggaccaaagtgatactacgaaacgactgtgctgcactatctcgtctctactccttcccgactactctcgtacgtactaacgg

SEQ ID NO: 345246 - DNA, 490 bp, Homo sapiens
  misc_feature: GZ8MTXP02FHWE8.15.8.A08.1.454.CMB.2.raw
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcanagagttccactcncaccatcagcagcccnagtctagaatntttgctagtttatactgtcagacaataataacaagtgacctattctactttcggaccctagggaccaaagtggataatacaaacgactgtggctgcacatctgtctcatctccgcactctgacgctacg

SEQ ID NO: 345247 - DNA, 568 bp, Homo sapiens
  misc_feature: GZ8MTXP02G7LA7.15.8.A08.1.454.CMB.2.raw
  modified_base (168)..(168): a, c, t, g, unknown or other
  misc_feature (168)..(168): n is a, c, g, or t
  modified_base (384)..(384): a, c, t, g, unknown or other
  misc_feature (384)..(384): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttacgcctggtaccaacagaaacctggccagcctcccaggcctctcatcatgctgcatccagttagggctacgtggtactcccgagcctagggttcaggtcggactagggttgggtctagggacacggagtacgttccccaccttctacaacctatccgagccacgtccccgntagtcctagtaagttcttttagacttagtttatacgtcgttacagtactaataataacgaacgtgacctattcgtacgtttaccggccgaagggtaacctaaggtgtaatactaacgaaacgtacgtagtggtcacgacacctatctcgttactctactcgtccactactctagactacgtacg

SEQ ID NO: 345248 - DNA, 513 bp, Homo sapiens
  misc_feature: GZ8MTXP02G7UQD.15.8.A08.1.454.CMB.2.raw
  modified_base (168)..(168): a, c, t, g, unknown or other
  misc_feature (168)..(168): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (492)..(492): a, c, t, g, unknown or other
  misc_feature (492)..(492): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctctcatctatgctgcatccattagggacactggtactccagccaggttcagtggcaggtggtctggcacgagagttcccactctcaccatcagcacgcccgnagtctgaaagtntttgctagtttattctgtcagtacaatactaaacaagtgaccagttctactttcggcccagggaaccaaagtggaataatacaaacgtaactggtgctgacactatctcgtactctactccttcccnctactctacgtactacgtacg

SEQ ID NO: 345249 - DNA, 568 bp, Homo sapiens
  misc_feature: GZ8MTXP02G5RUF.15.8.A08.1.454.CMB.2.raw
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
  modified_base (480)..(480): a, c, t, g, unknown or other
  misc_feature (480)..(480): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagcccaccctctcctgcagggccagtcagagagttgccgctagtttagcctggtaaccaacagaaacctggccagccctcccgaggcctcctcatctatgctgcatccagttaacgggactacgtggtactacccgagcctaggttcaggtcggctagggtgggtctggacacgagtacgttccactctcaccatcagcacgccganagtctagaagtntttgacttagtttatactgtacagacaaataactaaacaagtcggacctattctaccgtttccggacctaacgggaaccaaaggtgaataanaacgaaaacgtaactggacgtctacgacctaaccattcgttcgttaccttactacctccttcccgacctatcgtagacgtactaacgg

SEQ ID NO: 345250 - DNA, 514 bp, Homo sapiens
  misc_feature: GZ8MTXP02F1T5S.15.8.A08.1.454.CMB.2.raw
  modified_base (168)..(168): a, c, t, g, unknown or other
  misc_feature (168)..(168): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccgaggcctcctcatctatgctgcatccattaggacacgtggtacncccagccaggttcagtggcaggtggtctggcagagtacgttccactctcaccatcagcacgccccgnacgtctagaaagtntttgcttagtttacttactgtcagctaaatataacagtcgactattctacgttcgacccaagggaaccaagtgatactacaaacgagtgtgactgacactatctcgtcttcactcctcccgactactcctagactactacg

SEQ ID NO: 345251 - DNA, 617 bp, Homo sapiens
  misc_feature: GZ8MTXP02H37QM.15.8.A08.1.454.CMB.2.raw
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggcctcctcatctatgctgcatccagttagggacacgtggtactccccagccaggttcaggtggctaggtgggtctggacacgagtagttccactctcaccatcagcacgcccnagtctgaattntttgactagtttatactgtcagtacaattaactaaacgtagtcggacctaatttccgtacgttttccggaccccgtaaggggaacccgtaaaaggtacggaaattaacgtaacgtaaaaccgtaacgtggtacggtacttacggaccctaaacctaacttccttacgttacctttaccgaacctttccccgttacccccggtaaccctactttccgtaaccggtacgttacccgttaaaccggg

SEQ ID NO: 345252 - DNA, 489 bp, Homo sapiens
  misc_feature: GZ8MTXP02G8QA7.15.8.A08.1.454.CMB.2.raw
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctccaggctcctcatctatgctgcatccattaggacactggatcccagccaggttcagtggcaggtggtctggcanagagttccactctcaccatcagcagcccgnagtcngaagtatttgctagtttatactgtcagcaaatataacaagtggaccattcactttcgccagggaccaagngatatacaaagaactgtagctgcaccatctcgtcttcatccttcccgccactctcgacgtactaacg

SEQ ID NO: 345253 - DNA, 530 bp, Homo sapiens
  misc_feature: GZ8MTXP02HRTRQ.15.8.A08.1.454.CMB.2.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcagtttagcctggtaccaanagaacctggccagcctcccaggctccncatctatgttgcatccattagggacatggtacncccagccaggttcagtgcaggtgggtctggcacagagttcacctctcacatnagcngccctnagtctagagtattttgctagtttattacgtntananataataataactaagtacgtactacttactacgttaccgtaccgacggaacgtaagtagtatactaacgtaacgtaacgtagtcgtcgtcgacactactctctcttctactcctcccgtctactctacgtacgtacgtacgtacg

SEQ ID NO: 345254 - DNA, 613 bp, Homo sapiens
  misc_feature: GZ8MTXP02GYL4M.15.8.A08.1.454.CMB.2.raw
  modified_base (168)..(168): a, c, t, g, unknown or other
  misc_feature (168)..(168): n is a, c, g, or t
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctaggtaaccaacagaaacctggccagccctcccgaggcctcctcatctatgctgcatccagttaggactagtggtacncccagccaggttcagtgcaggtgggctggcacgagtacgttccacctctacaaccatcagccgacgcccgcgacgttctagaaagttntttgcttagtttatacgtgtactagtactaataactaaacgtagtcgtacctacgtttacctaccgtttaccggacccgtaacggggtaaccctaaaggtacggtaataacgtaaccgaaaacgtaacgtaggtcgtacgtcggtaccaccgtagttaccgttacgttcctttacctaccgtttcccgttccccgtacctacgttccttacgacgtacgtttaaaccgg

SEQ ID NO: 345255 - DNA, 541 bp, Homo sapiens
  misc_feature: GZ8MTXP02I7LVR.15.8.A08.1.454.CMB.2.raw
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttagcctggtaccaacagaaacctggccagcctcccgaggcctcctcatctangctgcatccagttaggacactggtacncccagccaggttcagtggcaggtggtctggacacgagtattccactcctacacntcagcacgcccncagtctagaagtntttgctagtttatactgtcagcaataataacagtcgactattaccacgtttccggacccgtagggaacctaaagtggaataatacgtaaaacgacttggaacggtctagccaacctattcgtcgttcttacacttccgttcccgacctacgtactcgacgtcttaacgg

SEQ ID NO: 345256 - DNA, 508 bp, Homo sapiens
  misc_feature: GZ8MTXP02FQL90.15.8.A08.1.454.CMB.2.raw
  modified_base (169)..(169): a, c, t, g, unknown or other
  misc_feature (169)..(169): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
tcagtctacgtagccacgaccggtgctcgatttagcatactctacagggtggctgggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaacagaaacctggccagcctcccaggctcctcatctatgctgcatccattagggacactggtactccagccaggttcagtggcaggtgggtctggcacgagacgttccactctcacctatcagcagccccganacgtcagaacgtntttgctagttatactgtcagacaatataacagtgcctattcacgttcgaccagggaccaaagtggatagtacaaacgtactagtggctcgacacctatcctgtcttctactccttcccgctactctaggactctaacg

SEQ ID NO: 345257 - DNA, 577 bp, Homo sapiens
  misc_feature: GZ8MTXP02HP2GT.15.8.A08.1.454.CMB.2.raw
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttagcctggtaccaacagaaacctgccagcctcccaggctctcatctatgctncactacagtagacacgtagtactccacgcgacgtcgagtgngagtggtcgtgacgagagtagtccactctacacacacacgcgacgccgacgacgtacgtagtaagttattagtacttagtttacttacgtacgtactacgtactaaataaataaacgtaagtacgtactacttacttaccgttaccgtaccgaacggaacgaaagtagtaagtaactaacaaacgtaacgtagtacgtacgacgactactactacttcgttacttactacttaaccgttaccgtacctactacgtacgtacgtacgtacg

SEQ ID NO: 345258 - DNA, 652 bp, Homo sapiens
  misc_feature: GZ8MTXP02IWBSW.15.8.A08.1.454.CMB.2.raw
  modified_base (398)..(398): a, c, t, g, unknown or other
  misc_feature (398)..(398): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgccagtttagcctggtaccaacagaaacctggcccagcctcccaggcctcctcatctatgctgcatccagttagggactactggtactcccagcccgaggtttcaggtggctaggttgggtctgggcacgagtacgtttcccacttcctacacctatccagccaacgcccccgatacgtcgtaggaaagttntttcgacttagtttattactgtacagtactaaataacgtaaacaaacgtcggtacctaactttaccgtaaccgttttaccgggacccccgtaacggggtaaacccgtaaaacggtagggtaacttaacgttaaaccgaaaaaccggtaaaccgtaggttacgggtacttacggacctaacctaacgttaccttcgttcctttaccgtacttcccgttaccccgtacctactcgttacgtacgtacgttaaccgg

SEQ ID NO: 345259 - DNA, 536 bp, Homo sapiens
  misc_feature: GZ8MTXP02IWUW2.15.8.A08.1.454.CMB.2.raw
  modified_base (292)..(292): a, c, t, g, unknown or other
  misc_feature (292)..(292): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccagttagggaccacgtggtacncccagccaggttcagtggcagtggtctggcacagtagttccactctcaccatcagcacgcccgtcagtctagtaaagtctttgctagtttatactgtcagacaataataacagtcgactactttccacgtttccggacccgaaggggacccaaaggtggaatacgtaacaaacgtaacgtgtggactcgacacctagtctcgtacttcacttccgttcccactactcgtacgacgtacttaacg

SEQ ID NO: 345260 - DNA, 601 bp, Homo sapiens
  misc_feature: GZ8MTXP02JXPFA.15.8.A08.1.454.CMB.2.raw
  modified_base (169)..(169): a, c, t, g, unknown or other
  misc_feature (169)..(169): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (256)..(257): a, c, t, g, unknown or other
  misc_feature (256)..(257): n is a, c, g, or t
  modified_base (260)..(260): a, c, t, g, unknown or other
  misc_feature (260)..(260): n is a, c, g, or t
  modified_base (264)..(265): a, c, t, g, unknown or other
  misc_feature (264)..(265): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaancgccaccctctcctgcagggccagtcaggagtgtcgccacgttagtcgcgtacgaacaagaacgacgcgacnctccncgcgtcctcnnctntgcnncnctactacgtaggtacgactgtcgtccncgcgacgtgtacgaggtcgagtggtcgngcgacagngtactccnctccacactcacgacgccgaccgcctagtacgtcgtaagttaatttgtcgtaacttttagtttactcgtacgacgtaataaacttaaacgtaaacgtaacgtcggtacctaacctttcgttaccgttacccgggtaccgaacgggaacgtaaagtaaggtacttaactaaccgaaacgtacggttgtcgaacgtctacgactacgttgtcttactcctaacttcccttcccgacctatacgtcgtacgtaccgtacgtaacgg

SEQ ID NO: 345261 - DNA, 520 bp, Homo sapiens
  misc_feature: GZ8MTXP02IP69M.15.8.A08.1.454.CMB.2.raw
  modified_base (169)..(169): a, c, t, g, unknown or other
  misc_feature (169)..(169): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (464)..(464): a, c, t, g, unknown or other
  misc_feature (464)..(464): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagngccaccctctcctgcagggccagtcagagagttgccgccagtttagcctggtaccaacagaaacctggcccagcctcccaggttcctcatctatgctgcatccagttacgggacactggtactccccagccaggttcagtggcaggtgggtctggcacagagttcacctctcaccatcagccnggcccnagtctgaaagtnttttgctagtttattactgtacagacaatataacgaagtcgcctattctacgttcggaccctagggaccaaaggtgactatacaaaacgtatgngctagccacactcttctctactacttcctccgctactcgtacgacgtactacgtag

SEQ ID NO: 345262 - DNA, 565 bp, Homo sapiens
  misc_feature: GZ8MTXP02F95CD.15.8.A08.1.454.CMB.2.raw
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctatgctgcatccattagggacactggtatcccagccaggttcagtggcaggtgggtctggcacagagttcccactctcaccatccagcacgcccgnagtctagaaagttntttgattagtttatactgtacagactaaataactaacgagtcgacctacttacctacgtttaccggaccgaacgggaaccaaaggtgaatactaacgaaacgtaacgtgtacggtactacgacctacctacgttcgttacgttaccttactaccttcccgttccccgtacctactacgtacgtacgtacgtaacg

SEQ ID NO: 345263 - DNA, 663 bp, Homo sapiens
  misc_feature: GZ8MTXP02IGS6O.15.8.A08.1.454.CMB.2.raw
  modified_base (168)..(168): a, c, t, g, unknown or other
  misc_feature (168)..(168): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaacagaaacctggccagccctcccaggcctcctcatctatgctgcatccagttacgggacacgtggtactcccgagccaggttcaggtggcaggtgggtctggcacagtagttcccactctcacntcagccacgcccgntagtctagagttatttcgactacgtttatactggtacacgtactaaataacgtaaactagtacggaccttaacgtttacctaccgttttaccccggacccccggtaaggggtaaacccctaaagggtacggtaacttaacgttaaaccgaaacggtaaaccgtggtacgggtactaaccggaccaaaccccgttagttacccgttcgttaaccccttttacgtaacccgtttcccctttacccccggtacccgttaccctttaccggtaccggttaacccggtaaccgtttaaacccgggg

SEQ ID NO: 345264 - DNA, 557 bp, Homo sapiens
  misc_feature: GZ8MTXP02H4ZT4.15.8.A08.1.454.CMB.2.raw
  modified_base (168)..(168): a, c, t, g, unknown or other
  misc_feature (168)..(168): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcaggccagtcagagagttgccgcagtttagcctggtaccaacagaacctggccagccctcccaggcctcctcatctatgctgcatccattagggacnctggtactccgagccaggttcagtggcaggtggctggcanagattccactctcacatcagcacgcccnagtcaggaaatntttgctagtttattactgtctagactaataataacagtaggcctagtttctacgtttcggacccgaagggaaccctaaaggtaggaacttaacgtacgaaaaccgtaacgttcgtacggtctacggacctacctaacttcctacgttccttactacttcccttcccgacctacttcctacgtacgtcgttaaaccgg

SEQ ID NO: 345265 - DNA, 525 bp, Homo sapiens
  misc_feature: GZ8MTXP02FN24R.15.8.A08.1.454.CMB.2.raw
  modified_base (168)..(168): a, c, t, g, unknown or other
  misc_feature (168)..(168): n is a, c, g, or t
  modified_base (364)..(364): a, c, t, g, unknown or other
  misc_feature (364)..(364): n is a, c, g, or t
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattagggacactggtactccccgagccaggttcaggtggcaggtggggtctgggcacgagtagttccactctcaaccatcagcacgccccganagtctagaaacgtattttgctagtttatactgtcagctaataataacaagtcgacctattcacgtttccggcccagggaaccaagtaggatagtacaaaccgtagtgtacgctgacacatctcgttactnactccgttcccnctactcgtagacgtctacg

SEQ ID NO: 345266 - DNA, 560 bp, Homo sapiens
  misc_feature: GZ8MTXP02IAPXS.15.8.A08.1.454.CMB.2.raw
  modified_base (327)..(327): a, c, t, g, unknown or other
  misc_feature (327)..(327): n is a, c, g, or t
  modified_base (484)..(484): a, c, t, g, unknown or other
  misc_feature (484)..(484): n is a, c, g, or t
  modified_base (511)..(511): a, c, t, g, unknown or other
  misc_feature (511)..(511): n is a, c, g, or t
tcagtctacgtagccacgaccggtgctcgatttagcatactctacagggtggctggagactgcgtcatcactacttctcttcctcctgctactctggctccccagataccactggagaagtagtgatgacgcagtctccagccaccctgtctgtgtcgtccgggggaaagagccaccctctcctgcaggccagtcagagagttgccgcagtttagcctggtaccaacagaaacctggccagcctcccaggcctcctcatctatgctgacatcctagttacgggacacgtggtactccccgagccaggttcaggtggctaggtggtcnggacacgaggtacttcccactctaccaccatccgacgccacgtcccgactagtctagaagttatttcgatagttttatacttgactagactaaatataaacgagtcgacctatttccgtacgtttccggaccgaagggaacctaaaggtgaattaanacaaaacgtagtgaggtcacgcaactntccttctccttactacttcccgtccactactcgtacgtacgtacgtacg

SEQ ID NO: 345267 - DNA, 618 bp, Homo sapiens
  misc_feature: GZ8MTXP02GA2RD.15.8.A08.1.454.CMB.2.raw
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
tcagtctacgtagccacgaccggtgctcgatttagcatactctacagggtggctggagactgcgtcatcactacttctcttcctcctgctactctggcctcccagataccactggaagaagtagtgatgacgcagtctccagccacctgtctgtgtcgtaccggggaaagacgccaccctctcctgcgaggccagtcagagagttgccgctagttacgcctggtaccaanagaaacctggccagccctccaggcctctcatctangctgctatccagttacggactacgtggtactcccgagtccgtaggtttaccaggtcggactagggtcggttcgtcggaccagtagtacgttcccacctcctacgacctatccgagccaccgcccganacgttctagaacgtttatttcgnttaaagtttattacgtgtacagactaaataacgtaaacagtcgtactacgttctaccgtttccggacccgaacgggtaaccgtaaagtacgaacttactaaacgaaaacgtaaccgtggtacggtactcggacctaccgtacgttcctcgttaccttctaccttcccgttacccgtactactcgttacgaccgtacgttaacg

SEQ ID NO: 345268 - DNA, 586 bp, Homo sapiens
  misc_feature: GZ8MTXP02GJ4SH.15.8.A08.1.454.CMB.2.raw
  modified_base (379)..(379): a, c, t, g, unknown or other
  misc_feature (379)..(379): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttagcctggtaccaacagaaacctggccacgccctcccaggcctcctcatctatgctgcatccagttacggacacgtggtactcccagccaggttcagtggcaggtggtctggacacgagtacgttccactctacaccatccagccacgccgcagtctagaaattntttgacttagtttacgttactgtacaagtactaaataacgtaaacgagtacgtaccttattacctaccgtttaccggacccgtaagggtaaccgtaaaggtacgtaataacgtaacgaaacgtacgtacggtacgtacgtacgacctacctattcgttcgttacttctacttccgtcccgactctacgtacgtacgtacgttaacgg

SEQ ID NO: 345269 - DNA, 511 bp, Homo sapiens
  misc_feature: GZ8MTXP02IA3ZP.15.8.A08.1.454.CMB.2.raw
  modified_base (168)..(168): a, c, t, g, unknown or other
  misc_feature (168)..(168): n is a, c, g, or t
  modified_base (258)..(258): a, c, t, g, unknown or other
  misc_feature (258)..(258): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggcctcctnatctatgctgcatccattagggacactggtactccagccaggttcagtggcaggtggtctggcacagagttcccactctacaccatcagccacgcccgnagtctaggaatntttgntagtttatactgtcagacaatataaacagtgacctattcacgtttcggacccagggaccaaagtcgatanacaagactgtgctcgcactntacttcgtacttcactccttcccgactactctagtacgtacgtaacg

SEQ ID NO: 345270 - DNA, 536 bp, Homo sapiens
  misc_feature: GZ8MTXP02GQR86.15.8.A08.1.454.CMB.2.raw
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtactcccagccaggttcagtggcaggtgggtctggcagagagttccactctcaccatcagccagccccnagtctagaagtntttgctagtttattactgtcagactaatataacaagtgacctattctacgtttcgacccaggggaaccaaagtcggaatagtaacgaaacgacgtaggtcgtactacgccactattccgtcgttccttacacttccttccccgactactccgttagacgtacttaaccgg

SEQ ID NO: 345271 - DNA, 571 bp, Homo sapiens
  misc_feature: GZ8MTXP02GO4T0.15.8.A08.1.454.CMB.2.raw
  modified_base (168)..(168): a, c, t, g, unknown or other
  misc_feature (168)..(168): n is a, c, g, or t
  modified_base (367)..(367): a, c, t, g, unknown or other
  misc_feature (367)..(367): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggctcctcatctatgctgcatccattagggacactggtactcccgagccctaggttcaggtggcaggtggggtctggcacaggagttcccaactctacaccatccaagcacgccccgntagtcctggaagtattttgacttacgtttattacctgttccagactaaataactaaacgagtacggacctattcctacgtttccggaccccgtaggggaacccaaaggtggaattacgtaacaaacgtacgtacgtggactcgacacctactactcgttccttcgtactccgttccccgactacgtctacgacgtcgttaacgg

SEQ ID NO: 345272 - DNA, 583 bp, Homo sapiens
  misc_feature: GZ8MTXP02HII8X.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcaggccagtcagagagttgccgccagtttagcctggtaccaacagaaacctggccagcctcccaggctcctcatctatgctgcatccagttagggactacgtggatccccagccaggttccaggtggcaggtggtctggcacgagagttcccactctacaccatcagcacgtcccgatagtctaggaaattgtttagcgttaagttttattaccgttgtactagtacctaaataactaaacaacgtacggacctactttacctacgttttaccggacccgtaacggggaaccctaaaggtcggtaataacgtaacgaaacgtaacgtaggtcgtacgtcgacctaccctattctcgttacctctacttccgtccctactactctacgtacgtacttaacg

SEQ ID NO: 345273 - DNA, 560 bp, Homo sapiens
  misc_feature: GZ8MTXP02JTDQN.15.8.A08.1.454.CMB.2.raw
  modified_base (168)..(168): a, c, t, g, unknown or other
  misc_feature (168)..(168): n is a, c, g, or t
  modified_base (227)..(227): a, c, t, g, unknown or other
  misc_feature (227)..(227): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
  modified_base (401)..(401): a, c, t, g, unknown or other
  misc_feature (401)..(401): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaanagaaacctggccagccctcccaggctcctcatctatgctgcatccagttagggacactggtactcccagccaggttcaggtggcaggttcggggtctggcacgagtagttcccactctacacctntcancacgtcccggctagtctaggaaatntttgacttagtttattactntcagacaataataacagtgacctattactacgtttccggacccgtaaggggaaccaaggtacggaataactacaaaacgtaacgtggtacggtctacgccaacctatccttcgtacttcacttccctacccgtactactctcgtaacgtaccttaacgg

SEQ ID NO: 345274 - DNA, 714 bp, Homo sapiens
  misc_feature: GZ8MTXP02G94GK.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccggggaaancgcccaccctctcctgcgaggccagtcagagtagttcgccgctagtttacgcctaggtaaccaacacgaaaccgtcggaccacgccctcccgagtcctcctcatctatcgctgaccactccgtagttacggactacgtggtacctcccgagtccgtaggttcaggtgacgtagggtcgggtctcggactagtacggtacttccccacttcctaccgacctagaccgacgccgaccgcccgacgtacgttacgtaagggtaaactttcgttttacgacttttaagttttacgtaccgtagttacgaactaactaaattaaacgtaaacgtacggtcgtaaccttacgtttacccgtaacccggtttaccgggaaccccgtaagggtaaacctaaaggttacggtaactaaccgttaaacggaaacggtacgttcggggaccgttactaccggacctaaaccggttcgttcttaccgtttaccctacgttaacccttcccggttacccgaccttagttccgacggtaaccgttacgtttaaaccggg

SEQ ID NO: 345275 - DNA, 656 bp, Homo sapiens
  misc_feature: GZ8MTXP02JOJ1F.15.8.A08.1.454.CMB.2.raw
  modified_base (270)..(270): a, c, t, g, unknown or other
  misc_feature (270)..(270): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagcctccagccaccctgtctgtgtcgtaccgggggaaagagccaccctctcctgcagggccagtcagagagttgccgcctagtttagcctggtaccaacacgaaacctggcccagccctcccgaggcctcctcatctangctgcatccagttagggactactggtactccagcctaggttcaggtggcgtagggtcgggtctggacacgtagtacgttccccacttctaccaccatccgacgccgaccgccccgacgtacgtctaaggtaagttactttcgtactttaagtttattacgttgttaccgagtaactaaagttaactaaacgtacggtacggtaacctaacgtttacccgttaacccgtttacccgggaccccgtaaacgggtaacccggtaaaaggttacggtaaacttaacgtaaaccgtaaaacgtaaccgtggttaacggtctacgaccaccgtacttcgttcttaccttctacttcccgttccccgactactcgtacgtacgaccgtaacgg

SEQ ID NO: 345276 - DNA, 741 bp, Homo sapiens
  misc_feature: GZ8MTXP02IDVXK.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagacgccaccctctcctgcagggccagtcagagagttcgccgcctagtttagccttaggtaccaaacagaaacctggaccagccctcccaggcctcctcatctatgctgcatccagttaggacacgtggtactcccagccaggttcaggtggcagggtcgggtctggccaacgaggtacgtttcccaaccttcctaccaacctagttaccgacgccgacccggtccccgacgtagttccgtaggaaatttactttttacggtactttaaggtttttaactttacgtttacggttacctaagtaactaaagttaaacttaaaacgtaacggttacggtaccctttaacttttacccgttaaccggtttttaccccggggaacccccggttaaacgggggaaacccgtaaaacgggttagggtaaacttaacgttaaaccgaaaacggtaaaccgttggtaacggtaccgtacgaccctaaaccgttacgttaccgtttacgtttacctttcctaaccgtttccccgtttcccccgaaccttacttaccgttacgtaaccgttaccgttaaaccgg

SEQ ID NO: 345277 - DNA, 508 bp, Homo sapiens
  misc_feature: GZ8MTXP02GS489.15.8.A08.1.454.CMB.2.raw
  modified_base (168)..(168): a, c, t, g, unknown or other
  misc_feature (168)..(168): n is a, c, g, or t
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttagcctggtaccaanagaaacctggccagcctcccaggctctnatctatgctgcatccattagggacacgtggtactcccagccaggttcagtgcagtggtctggcanagnttccactctcacatcancacgcccgntagtctagaaagttntttgctaagtttattacgtgtacagactaatataacagtcgacctattactacgttccgacctagggaccaaagtgatacacaaacgactgagtctagacacatctacgtctcactctacccgtactactctagacgtactaacg

SEQ ID NO: 345278 - DNA, 626 bp, Homo sapiens
  misc_feature: GZ8MTXP02GZT9H.15.8.A08.1.454.CMB.2.raw
  modified_base (169)..(169): a, c, t, g, unknown or other
  misc_feature (169)..(169): n is a, c, g, or t
  modified_base (178)..(178): a, c, t, g, unknown or other
  misc_feature (178)..(178): n is a, c, g, or t
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccaccctntcctgcagggccagtcagagagttgccgcagtttagcctggtaccaanagaaacctggccagcctccaggctcctnatctatgctgcatccagttagggactacgtggtactccccgaagtccctaaggttccaaggttcggactagggttcggggtctgggacacgaggtacttcccacctctaccaaccatccagccacgccccgactagtcctaggaaagttctttgacttagtttattacgtacgtacaagtactaattaaataacgtaagtacggacctacttaccgtacgtttccggacccgtaacggggaacctaaaggtaggtaacttaacgtaaccgtaaaacgtaacgtacggtacggtacgtacgacctaacctacgttctacgttccttactaccttccgtccccgactacgtcctagtacgtacgtttaaaccgg

SEQ ID NO: 345279 - DNA, 513 bp, Homo sapiens
  misc_feature: GZ8MTXP02JD043.15.8.A08.1.454.CMB.2.raw
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcaggtgggtctggcacgagtagttccactctcaccatcagcagcccgnagtctagaagtntttgctagtttatactgtcagacaatataacagtgacctattcactttcggacccgtagggaaccaaaggtcggaatactacaaaacgactgtacggctcgacaccatctcgtactcactcctcccgcactctacgacgtactaacg

SEQ ID NO: 345280 - DNA, 557 bp, Homo sapiens
  misc_feature: GZ8MTXP02G57LO.15.8.A08.1.454.CMB.2.raw
  modified_base (169)..(169): a, c, t, g, unknown or other
  misc_feature (169)..(169): n is a, c, g, or t
  modified_base (291)..(291): a, c, t, g, unknown or other
  misc_feature (291)..(291): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgccagtttagcctggtaccaacagaaacctggccagcctcccaggctcctcatctatgctgcatccagttagggacactggtacnccccagcccaggttcaggtggcagggtgggtctgggcacgagtagttccactctcaccatccagccacgccccatagtctagaaagttatttgctagtttattactgtacagacaataataaacaagtcggactattctaccgtttccggacccgaacgggaaccaaagtaggaataactaacaaaacgaacgtgtcggactacgaccaccattctcgttacttcctactcccttacccgacctactctacgtacgtaccgtaacg

SEQ ID NO: 345281 - DNA, 695 bp, Homo sapiens
  misc_feature: GZ8MTXP02HEBBC.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaagacgcccaccctctcctgcagggccagtcagagagttcgccgcctagtttacgcctaggtaaccaacacgaaacctggcccagccctcccgaggcctcctcatctatgctgcatccaagttaggactacgtggtactccccagccctaggttcaggtcggctagggtcgggtctggaccacgtaggtacgttcccaccttctaccgacctatccgagccgacgcccccgatacgttccgttaaggaaacgtttagtttacgtacgttaagttttaacttacgttagtacgtaacgtacctaaaattaaacgtaaaacgtaacgtacggtacccttactttaccgtaaccgttttacccgggaccccgtaaacggggtaaacccgtaaaaggttacggtaaacttaacgtaacgtaaaaccgtaaccgtaggttacggtacgttacgacctacctaactccgttacgttaccttacctaccttcccttaccccgacctacttccgtacgtaacgtacgtttaaccgg

SEQ ID NO: 345282 - DNA, 583 bp, Homo sapiens
  misc_feature: GZ8MTXP02FI7ZS.15.8.A08.1.454.CMB.2.raw
  modified_base (168)..(168): a, c, t, g, unknown or other
  misc_feature (168)..(168): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccacctctcctgcagggccagtcagagagttgccgccagtttagcctggtaccaacagaaacctggccagcctcccaggctcctcatctatgctgcatccagttacgggacacgtggtactcccgaagccctaggttcaggtggcaggtcgggtctggcacgagtagttccactccncaccatcagcacgccccgngagtctagaagttatttgacttagtttactactgtctacgactaaataactaacgaaagtcgtacctagttactaacgtttccggacccgtaacgggaaacctaaaggtaggtaataacgtaacgaaaacgtacgtggtaacggcttcgacctacctattcgtacgttacctctaacgttcccgttacccgtactactctacggactcgttaaacgg

SEQ ID NO: 345283 - DNA, 509 bp, Homo sapiens
  misc_feature: GZ8MTXP02GEQNZ.15.8.A08.1.454.CMB.2.raw
  modified_base (169)..(169): a, c, t, g, unknown or other
  misc_feature (169)..(169): n is a, c, g, or t
  modified_base (294)..(294): a, c, t, g, unknown or other
  misc_feature (294)..(294): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (489)..(489): a, c, t, g, unknown or other
  misc_feature (489)..(489): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttgccgcctagtttacgcctggtaccaaacagaaacctggccagccctcccaggctcctcatctatgctgcatccattagggacactggtacncccagccaggttcagtggcaggtgggtctggcacagtacgttccactcctcaccatccagccacgccccgnagtctagaagtntttgctagtttatactntcagcaatanacaagtgactatctacgttcgaccaagggacaaagtggatatacgaaacacgtagtgctgcacatctctactctactccgtcccnctactctagacgtactaacg

SEQ ID NO: 345284 - DNA, 550 bp, Homo sapiens
  misc_feature: GZ8MTXP02JC3SD.15.8.A08.1.454.CMB.2.raw
  modified_base (258)..(258): a, c, t, g, unknown or other
  misc_feature (258)..(258): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctccttanctatgctgcatccattagggacactggtactcccagccaggttcagtggcaggtgggtctggcacagtagttcacctctcaccatcagcncgcccnagtctgaagtattttgctagtttattactgtcagctaaatataaacaagtcggacctattcctacgtttccggcccaaggggacccaaaaggtcgaatatacaaaacgtactggtacggctaggccaacctactcttcgttaccttcaacttcccttaaccccgcctaacttcctagtacgtaccgtacggttaag

SEQ ID NO: 345285 - DNA, 572 bp, Homo sapiens
  misc_feature: GZ8MTXP02GGZQT.15.8.A08.1.454.CMB.2.raw
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaaccaacagaaacctggccacgcctcccaggcctcctcatctatgctgcatccagttagggacacgtggtactccccagccaggttcaggtggcaggtgggtctggcacgagtagttccactctacaccatcagccacgcccgnagtctaggaaacgttatttgacttagtttattacgtgtacagactaaataataacagtcgacctattacacgtttcgacccgagggaacctaaaggtcggaataagtaacgaaaacgtacgtagacggtcgtacgcaacccttatccgttacgttccttactaccttccgttccccgtactactccgtagtacgtacgttaaaccgg

SEQ ID NO: 345286 - DNA, 518 bp, Homo sapiens
  misc_feature: GZ8MTXP02FRFGR.15.8.A08.1.454.CMB.2.raw
  modified_base (168)..(168): a, c, t, g, unknown or other
  misc_feature (168)..(168): n is a, c, g, or t
  modified_base (257)..(257): a, c, t, g, unknown or other
  misc_feature (257)..(257): n is a, c, g, or t
  modified_base (321)..(321): a, c, t, g, unknown or other
  misc_feature (321)..(321): n is a, c, g, or t
  modified_base (352)..(352): a, c, t, g, unknown or other
  misc_feature (352)..(352): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagccctcccaggctcctnatctatgctgcatccattagggacatggtatcccagccaggttcagtggcagtgggtctggcanagagttccactctcaccatcagcacgcccgnagtctagagttatttgctagtttatactgtcagactaatataacgaagtcgacctattcctaccgtttcggaccctaaggggacctaaaggtggaatatacaaagtactgtacgctagcactatctacgtactctactccttcccgactacgtctgacgcttaacg

SEQ ID NO: 345287 - DNA, 608 bp, Homo sapiens
  misc_feature: GZ8MTXP02FUJ0F.15.8.A08.1.454.CMB.2.raw
  modified_base (168)..(168): a, c, t, g, unknown or other
  misc_feature (168)..(168): n is a, c, g, or t
  modified_base (262)..(262): a, c, t, g, unknown or other
  misc_feature (262)..(262): n is a, c, g, or t
  modified_base (297)..(297): a, c, t, g, unknown or other
  misc_feature (297)..(297): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaancgccaccctctcctgcagggccagtcagagagttgccgcctagtttacgcctaggtaccaacagaaacctggaccagccctcccaggctccctnatctatgctgcatccagttacggacacgtggtacncccagtccaaggttcaggtggctagggtggtctggacacgtagtacgttccaccttcaccaacctatccaagccacgcccccggtatacgttctagaaagtttctttacgacttagtttataactgtacagactaataactaacgaagtacgactacttctacgtttcgacccgtaaggaaccaaagtagataacgtaacaaacgtaacgtcgtacggtactacgacctaccgtaattccgtacgttaccgtcctaccgttaaccccgtttccggaccctaacgttccttacggaacgtacccttaaacgg

SEQ ID NO: 345288 - DNA, 634 bp, Homo sapiens
  misc_feature: GZ8MTXP02HORX8.15.8.A08.1.454.CMB.2.raw
  modified_base (376)..(376): a, c, t, g, unknown or other
  misc_feature (376)..(376): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccacccctctcctgcagggccagtcagagagttgccgcctagtttagcctggtaccaacagaaacctggccagccctcccaggctcctcatctatgctgcatccagttaggacactggtactccagccaggttcagtggcaggtggtctggcagagtagttccactcctacgacctatcagcgacgcccgctagtctagaacgtntttagctagtttatactgtcagactaaataactaacgagtacggtacctagtttaccctacgtttaccgggacccgtaacggggtaaacctaaagggttcggaattaacgtaaccgaaaaacggttaccgttgggtaaccgggttcctacggtaccaaaccgttacttccgttacgttacccgtttcctaaccgtttccccgttacccccgacctttacctacggtttacggtaaccgttaccgtttaaaacccgggg

SEQ ID NO: 345289 - DNA, 534 bp, Homo sapiens
  misc_feature: GZ8MTXP02GJIDV.15.8.A08.1.454.CMB.2.raw
  modified_base (368)..(368): a, c, t, g, unknown or other
  misc_feature (368)..(368): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctccaggctcctcatctatgctgcatccattagggacactggtatcccagccaggttcaggtgcaggtgggtctggcacgagtagttcccactctcaccatcagcacgcccgcagtctagaaagtntttgcttagtttatactgtcagactaataataaacgagtcggacctacttctacgtttccggacccgtaagggaacccaaagtcggattaacacaaacgtacgtgtggactcgctacactctcgttacttctacttccgtcccactactcctagacgtactaacgg

SEQ ID NO: 345290 - DNA, 518 bp, Homo sapiens
  misc_feature: GZ8MTXP02IE948.15.8.A08.1.454.CMB.2.raw
  modified_base (167)..(167): a, c, t, g, unknown or other
  misc_feature (167)..(167): n is a, c, g, or t
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
  modified_base (452)..(452): a, c, t, g, unknown or other
  misc_feature (452)..(452): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtctccgggggaaanagccaccctntcctgcagggccagtcagagagttgccgccagtttagccttggtaccaacagaaacctggccagccctcccaggcctcctnatctatgctgcatccagttagggacactggtactcccgagcctaggttcaggtggcaggtgggtcnggcacagtagttccactctcaccatcagcacgccgcagtctaggaactttntttgtatagtttatactgtanagataatanaacgagtcgactattctacgttcgaccgaggacaagtgatatacaanacgtgtgtctagactactacgtctacgttcttctactccgtccgactactacgtacgactactacg

SEQ ID NO: 345291 - DNA, 623 bp, Homo sapiens
  misc_feature: GZ8MTXP02IV2CQ.15.8.A08.1.454.CMB.2.raw
  modified_base (168)..(168): a, c, t, g, unknown or other
  misc_feature (168)..(168): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctcctcatctatgctgcatcccagttacgggactacgtggtactcccagccaggttcagtggcaggtgggtctggcacaggtacgttccactctcaccatccagccagcccgntacgtctaggaaatntttgctagtttatactgttcagtactaataactaaacgaagtcgtaccctatttaccgtaccgttttccgggaccccgtaagggggtaaaccctaaaaggttcgggtaaattaacgtaaccgtaaaaccggtaaccgttggtacggaccgttacggacctacccgtaattccgttacgttacctttacctaacgttcccttaccccggtacctaacttccgtacgtacgttaccgtttaaccgg

SEQ ID NO: 345292 - DNA, 639 bp, Homo sapiens
  misc_feature: GZ8MTXP02HCR3M.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaacctggccagcctcccaggcctctcatctatgctgcatccagttagggacacgtggtactcccagccaggttcagtggctaggtgggtctgggacagaggtacgttcccacttcctacaaccctataccgagccgaccgcccccgatacgtccgttaggaaaacgtttgttttacgtacttaacggtttttattaccgttggtacctaacgtacctaaaattaacgtaaaccgtaaagggttcggaaccttactttaccgttaccgttttacccgggaccccgtaacgggggtaaaccctaaagggtggtaaacttacgtaaacgaaaaccgtaacgttgtaacggtctacggaccacctatcttacgtccttactctccttaccgcctatcgtagacgtaccgtaacg

SEQ ID NO: 345293 - DNA, 612 bp, Homo sapiens
  misc_feature: GZ8MTXP02FKBLL.15.8.A08.1.454.CMB.2.raw
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctcctcatctatgctgcatccattagggacactggtatccccagccaggttcagtggcaggtgggtctggcacgagtagttccactctcaccatcagcacgcccgnagtcngaagtnttttgcttagtttattactgtacagactaaataataaacgaagtcggacctactttacctaccgttttccgggaccccgtaacggggaaccctaaaaggttagggtaacttaacgttaccggaaaaccgtaaacgttgggtacggtacgttacggacctaaccctattaccgttcgttacctttccttaacgttcccgtttcccccgtaccctacttccgtttacggacgtacgtttaaaccgg

SEQ ID NO: 345294 - DNA, 715 bp, Homo sapiens
  misc_feature: GZ8MTXP02HEN18.15.8.A08.1.454.CMB.2.raw
  modified_base (169)..(169): a, c, t, g, unknown or other
  misc_feature (169)..(169): n is a, c, g, or t
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccaccctctcctgcagggccagtcggagagttgccgccagtttagcctggtaccaanagaacctggcagcctcccaggcctcctnatctatgctgcatcccagttacgggactactggtactccccgagtcccgtaggttccaggtggacgaggttcggggtctgggccaagagtaacgtttccaccccttctaccaacccgatccacggccaccgggcccccgagtaacgtccgtaggtaaaacgttgtttttcggaccttagttttaacttaccgttggttaccaagtactaaataacgttaaaccgaaaggttcggaccctaaacgttttccctaaccgttttacccgggaccccgaaacggggtaaccccgtaaaaggttacgggaaatttaacgaaccgtaaaaaccgtacgtttgggtaacggccttacggacccgttaccgtaacgttccttaccggtttaccttccttaactttacccgggtttcccccgacccttaacggtttcttacggacgttacccgttaaggggtttaaccg

SEQ ID NO: 345295 - DNA, 601 bp, Homo sapiens
  misc_feature: GZ8MTXP02H0PRO.15.8.A08.1.454.CMB.2.raw
  modified_base (169)..(169): a, c, t, g, unknown or other
  misc_feature (169)..(169): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
  modified_base (425)..(425): a, c, t, g, unknown or other
  misc_feature (425)..(425): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgcccacccctctcctgccagggccagtcagagagttcgccgcctagtttagcctggtaccaacagaaacctggccagcctccgagcctccncatctangctgcactccaattacgggactacgtggtactccccgagccgtaggttcaggtggcaggttggtctggactacgagtgttcccacttccncaccatcagcacgccncagtctagaacgttntttagacttagtttatactagtacagactaataanaaacgagtcgtactattcctacgtttccggacccgaaggggaacctaaaggtacggtaaacttacgtaaccgaaaacgtaccgtagggtcgtacgtacggtacctaccgtaatcgtttacgtaccttccacttcccgtacccgtacctactaccgtcggtacggtaccttaacggg

SEQ ID NO: 345296 - DNA, 680 bp, Homo sapiens
  misc_feature: GZ8MTXP02FZ56M.15.8.A08.1.454.CMB.2.raw
  modified_base (169)..(169): a, c, t, g, unknown or other
  misc_feature (169)..(169): n is a, c, g, or t
  modified_base (304)..(304): a, c, t, g, unknown or other
  misc_feature (304)..(304): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccaccctctcctgcagggccagtcagagagttgccgcctagtttacgcctaggtaaccaaacagaaacctggcccagccctcccgaggcctcctcatctatcgctgctactccagttacgggacacgtgtaacncccgagccgtaggtcaggtggcagggtggtcgtggcacgtagtacgttccacctccacacctatccagcgacgcccgactacgtctagaacttatttgtacttagtttactacttcggtactaagtacctaaaattaacgtaaacgaaacggtcggtaccttacgtttaccgtacccgtttacccggaccccggtaaacggggaaaacctaaacgggtacggtaaattaaaccgtaaacgtaaaacccgtaacgttgggtacgtaccgaccgtaaccgtaaacctacgtttaccttcggtttacccttacgtaacctttcccccggttaccccgaccttaacgttccccgttaggaacccgtttacggtaaaccgg

SEQ ID NO: 345297 - DNA, 501 bp, Homo sapiens
  misc_feature: GZ8MTXP02IZ69V.15.8.A08.1.454.CMB.2.raw
  modified_base (168)..(168): a, c, t, g, unknown or other
  misc_feature (168)..(168): n is a, c, g, or t
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
  modified_base (332)..(332): a, c, t, g, unknown or other
  misc_feature (332)..(332): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctccaggctctnatctatgctgcatccattaggacactggtacnccagccaggttcagtggcaggtgggtctggcacagagttccactcncaccatccagcagcccnatcngaaagttnttagntattatacgtntacanacaatanaacgagtcgactattctacttccgaccgacggaccaagtgatanacaacgactgtacgcncacactatctcgtacttctactccgtcccgactactcgtacgacgtactacg

SEQ ID NO: 345298 - DNA, 653 bp, Homo sapiens
  misc_feature: GZ8MTXP02HSUBQ.15.8.A08.1.454.CMB.2.raw
  modified_base (166)..(166): a, c, t, g, unknown or other
  misc_feature (166)..(166): n is a, c, g, or t
  modified_base (175)..(175): a, c, t, g, unknown or other
  misc_feature (175)..(175): n is a, c, g, or t
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
tcagtctacgtagccacgaccggtgctcgatttagcatactctacagggtgggctggagactgcgtcatcactacttctcttcctcctgctactctggctcccagataccactggagaagtgtgatgacgcagtctccagccacctgtctgtgtctccggggaaangccaccctntcctgcagggccaggtcagacgagttgccgctagttagcctggtaccaanagaacctggccagcctccgagcctctcatcgtatcgcctanctatccagtacgctgtgtaccnccgagcctaggtcaggtcggacgtgggtcggtctcggacacgtaggtacgttccctaccgtcctaccgaacgtagtaccgaggtcccgacggtccctattacgtaccgtaagttaaagttcgtttacgacttacgtttactacgttcgtacgtacgtactaactaagtaaacgtaacgtacgtacgttacgttacgttaccgttaccggtaccggtaaccggtaaaccgtaaacgtaacgtaacgtaacgtaacgtaaacgtaacgtacggtacggtacgtacgtacgtaactacgttacgtaccgttaccgttactaccgttaacccgttacccgtaccgtacgtacgtacgtacgtacgtacg

SEQ ID NO: 345299 - DNA, 583 bp, Homo sapiens
  misc_feature: GZ8MTXP02GDKFA.15.8.A08.1.454.CMB.2.raw
  modified_base (168)..(168): a, c, t, g, unknown or other
  misc_feature (168)..(168): n is a, c, g, or t
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
tcagtctacgtagccacgaccggtgctcgatttagcatactctacagggtggctggagctgcgtcatcactacttctcttcctcctgctactctggctcccagataccactggagaagtagtgatgacgcagtctccagccaccctgtctgtgtcgtccgggggaaanacgccaccctctcctgcagggccagtcagagagttgccgcagtttagcctggtaccaacagaaacctggccagccctccaggctcctcatcatgctgcatccagttagggacacgtggtactcccagccaggttcaggtggcaggtgggtctggcacagtacgttcccactctacaccatcagccacgccccgnacgtctagaagtcttttagcttaagtttataactgtacagacaatactaanagtcgacctattctacgtttccgaccgacgggaaccaaagtcggataactaacaaaacgaacgttgaacgtcgtacgtaccaaccgtacttcgttacgttaccttactaaccgtttcccctttacccccggacttaacgttcccgttaaggacgtacccgtttaaaccgg

SEQ ID NO: 345300 - DNA, 509 bp, Homo sapiens
  misc_feature: GZ8MTXP02IDO3U.15.8.A08.1.454.CMB.2.raw
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctccaggcctcctnatctangctgcatccattacgggacacgtggtactcccagcctaggttcagtggcaggtggtctggcacngattccactctcacgatcagcacgccgcagtcctagaattnttgtacagtttatcgtgtcagacaatataanagtgactnttacacgtttcgccgtagggacctaagngtatatacgaaagtaactgtacgtctgctacctatctctacttcacgtcctccactactcgtcgacgtactacgg

SEQ ID NO: 345301 - DNA, 608 bp, Homo sapiens
  misc_feature: GZ8MTXP02GBQF9.15.8.A08.1.454.CMB.2.raw
  modified_base (169)..(169): a, c, t, g, unknown or other
  misc_feature (169)..(169): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgcctagtttacgccttaggtaaccaacagaaacctggccagccctccaggcctcctcatctatgctgcatccagttagggacctacgtggtactcccgagccgtaggttcagtggcaggtggtcnggcanagtgttccactcncaccatccagccagcccanacgtctagaaacgtttntttagtacttagtttacttacgtgtacagactaaataactaaacgtagtacgtacctactttacctaccggtttccggaccgtaacgggaaacctaaaggtagtaacgtaacgtaaacgaaaacggtaacgtggtacgactacgacctacgtacgttcgttacgttaccttacctacgttcccgttacccgacgttactccgtacggacgtacgttaacgg

SEQ ID NO: 345302 - DNA, 681 bp, Homo sapiens
  misc_feature: GZ8MTXP02JIF3F.15.8.A08.1.454.CMB.2.raw
  modified_base (168)..(168): a, c, t, g, unknown or other
  misc_feature (168)..(168): n is a, c, g, or t
  modified_base (271)..(271): a, c, t, g, unknown or other
  misc_feature (271)..(271): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaanacgccaccctctcctgcagggccagtcagagagttgccgcctagtttacgccgtggtaaccaacgacgaaacctggaccagccctcccaggctcctcatctangctgcactccgtaagttacgggaccacgttggtactccccgaacggcccgtaggtttaccaggttcggacgtagggttcggtctcgggaccacgagtacgttccccactcctaccaccataccaacgccgtacgccccggtactaacgttcctaagggaaactttgttttacgtaccgttaggtttttaactacgtcggttaccgaatactaaacgttaataaacgaacgtgtaccctattaccgtacggtttccgaccgtacgggtaaacctaaaggtacggtaactaacgtaaccgaaacgtaaccgttagcgtacgttacgacctaaacctacgttaccgttcgttaaccttctaaccgttcccgttcccgtaaccgtacttcgtacggtactaccgtttaaaccgg

SEQ ID NO: 345303 - DNA, 723 bp, Homo sapiens
  misc_feature: GZ8MTXP02IF80N.15.8.A08.1.454.CMB.2.raw
  modified_base (169)..(169): a, c, t, g, unknown or other
  misc_feature (169)..(169): n is a, c, g, or t
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccacccctctcctgcagggccagtcagagagttcgccgccagtttagcctaggtaccaacagaaacctggccagccctcccaggcctccctnatctatgctgcagtccagttagggacacgtgtaccnccagcgtagtcngtgngtggtggtcngcagtagtactacccactccacacatacgacgccgtaccgcccgtacgtacgttcgtaaggtaaacgtttacgttttacgtacgtttaacgtttttacgttacgttacgttaaccgaacgtaaacgttaaaagttaaacgtaaaacggtaacggttaccgttaaccctttaacgtttaccccggttaacccggttttacccggggaaccccggtaaacgggtaaaacccgtaaagggttacggtaaactttaaacggtaaaaccgtaaaacggtaacgttcgggttacgtaccgtacgtaccctaaaccttacgttactttaccgttaccctttaccttacccgtttccccgttaccccgtaccttacgttaccgtacggtaaccttacccggtaacgg

SEQ ID NO: 345304 - DNA, 566 bp, Homo sapiens
  misc_feature: GZ8MTXP02H8VPF.15.8.A08.1.454.CMB.2.raw
  modified_base (169)..(169): a, c, t, g, unknown or other
  misc_feature (169)..(169): n is a, c, g, or t
  modified_base (263)..(263): a, c, t, g, unknown or other
  misc_feature (263)..(263): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcaggccagtcagagagttgccgcagtttagcctgtaaccaacagaaacctggccagccctccaggccttcctatctangctgcatccagttagggactacgtggtatccccagcctaggtcagtggcaggtgggtctggcacgagtagttccacctctcacagtcacgcncgccccganacgttctagtaagtattttgacttagttattactgtacagtactaataataacgaggtacgtctaatttccgtacgtttaccggacccgaagggaaccgtaaaggtacgaattacaacgtaaaacgtacgtggtacggctagacctacctattcgtacttctactactcctaacccgtcacgtctaggactacgtaacgacg

SEQ ID NO: 345305 - DNA, 512 bp, Homo sapiens
  misc_feature: GZ8MTXP02GNBZG.15.8.A08.1.454.CMB.2.raw
  modified_base (169)..(169): a, c, t, g, unknown or other
  misc_feature (169)..(169): n is a, c, g, or t
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
  modified_base (493)..(493): a, c, t, g, unknown or other
  misc_feature (493)..(493): n is a, c, g, or t
tcagtctacgtagccacgaccggtgctcgattagcatactctacagggtggctggagactgcgtcatcactacttctcttcctcctgctactctggctcccagataccactggagaagtagtgatgacgcagtctccagccaccctgtctgtgtcgtccgggggaaaanagcccaccctctcctgcagggccagtcagagagttgccgccagtttagcctggtaaccaacagaaacctggccagccctcccaggctcctcatctatgctgcatccattagggacatggtactcccagccaggttcagtggcagtgggtctggcanaggattcccactctcaccatcganccancccgtnagtctgaagtntttgctagtttatactgtnagcaaataataacaagtgacctattcacgtttcggacccaggggaaccaagtgatatacaaagaactgtggctgccactatcgtctcttctactccgttccccnctactcgagactacgtacg

SEQ ID NO: 345306 - DNA, 569 bp, Homo sapiens
  misc_feature: GZ8MTXP02JCQ53.15.8.A08.1.454.CMB.2.raw
  modified_base (168)..(168): a, c, t, g, unknown or other
  misc_feature (168)..(168): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggcctctcatctatgctgcatccattagggacatggtatcccagccaggttcagtggctaggtgggtctggcacagtacgttccactctcaccatcancagccccnacgtctagaagtntttgctagtttattactgtcagacaataataacagtggtacctatttcctacgtttccggacccgtacggggaaccctaaagggtaggtaactaacgttaaccgaaacgtaacgtggttacggacttcggaccacccgtattcttcgttacttacctacttcccgttaccccgtacctacttccgtagacgtacgttaacgg

SEQ ID NO: 345307 - DNA, 629 bp, Homo sapiens
  misc_feature: GZ8MTXP02ICCBW.15.8.A08.1.454.CMB.2.raw
  modified_base (170)..(170): a, c, t, g, unknown or other
  misc_feature (170)..(170): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagngccaccctctcctgcagggccagtcagagagttgccgccagtttagcctggtaccaacagaaacctggccagccctcccaggctcctcatctatgctgcatccaagttagggactactggtactccccgagcctaggttcaggtggctaggtgggtctggcacgagtagttccactctacaccatccgagccacgccccgatacgtcgtagaagttatttgactagtttattactgtcagactaaattaactaaacgaagtcggtacctacgttccgtaccgtttcccggacccggtaaggggaaccccgaaaaggttacgggaactttaacgtaacctaaaaccggtaacgttaggtcgggtactacggacctaccctacttccgttaccgtttaccgtttaccttacccgtttccccgttacccgaccttacttacgtacgtaccgtacgttaacgg

SEQ ID NO: 345308 - DNA, 572 bp, Homo sapiens
  misc_feature: GZ8MTXP02JZD5E.15.8.A08.1.454.CMB.2.raw
  modified_base (169)..(169): a, c, t, g, unknown or other
  misc_feature (169)..(169): n is a, c, g, or t
  modified_base (322)..(322): a, c, t, g, unknown or other
  misc_feature (322)..(322): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcaggccagtcagagagttcgccgcctagtttagcctaggtaaccaacaacgaaacctggaccagccctcccaggctccctcatctatgctgcatccagttacgggactacgtggtactcccagccaggttcagtggcngggtcgggtctggacacgagtagttcccactcactaccatcgacgccgacgccccgtacgtagtctaggtaaattacgttttgacttagtttacttactgtacagactaataactaacgagtcgactattctacgttccggaccgaagggaccaaagtcggatacgtaacgtaaacgacgttagcgtacgtcactaccattactcgtaccttactacgtccttcccgactactctcgaacgtccgttaag

SEQ ID NO: 345309 - DNA, 643 bp, Homo sapiens
  misc_feature: GZ8MTXP02HOGXF.15.8.A08.1.454.CMB.2.raw
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtcgtaccgggggaaagagccaccctctcctgcagggccagtcagagagttgccgccagtttagcctggtaccaacagaaacctggccagcctcccaggctccctanatcangcngcactcagtaggacagtgacnccagctagtcagtgacgtaggtggtcnggacagagtacgtcccactcacacancgagcacgccatagtcagtaattatttagacttaagtttaactacgttacgtacaacgtaactaaaacgtaaactaaaacgtaaacgtaacggtaccgttaacttaccgttaaccggtttacccggtaacccggtaaaccgggtaaaaccgtaaaacggtaacggtaaacgtaaacgtaaacgtaaaaccgtaaacgtaacggtacggtacgtacgaccgtaaacctacgttacgttacgttaccttacctaccttaacccgttacccgtaccgtacgtacgtacggtaacgtaacgtaacg

SEQ ID NO: 345310 - DNA, 568 bp, Homo sapiens
  misc_feature: GZ8MTXP02IG2MM.15.8.A08.1.454.CMB.2.raw
  modified_base (168)..(168): a, c, t, g, unknown or other
  misc_feature (168)..(168): n is a, c, g, or t
  modified_base (355)..(355): a, c, t, g, unknown or other
  misc_feature (355)..(355): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctctcatccatgctgcatccattagggacactggtactcccagccaggttcagtggcaggtgggtctggcacagacgttccactctcaccatcagcagccccganagtctagaagttatttgactagtttattacgtgtacagactaaataactaaacgtaagtcgacctatttaccgtaccgtttacccggacccgaagggaaccgtaaaggtagaataactaacgaaaacgtaacgtggtcggtactagaccaacctatccttcgttacttactacgttcccgttccccgacctactacgtacgtacgtactaacg

SEQ ID NO: 345311 - DNA, 538 bp, Homo sapiens
  misc_feature: GZ8MTXP02GIFB1.15.8.A08.1.454.CMB.2.raw
  modified_base (168)..(168): a, c, t, g, unknown or other
  misc_feature (168)..(168): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccattacgggacactggtactcccagccaggttcagtggcaggtggctggcacagtacgttccactcacaccatccgagcacgccccnacgtctagaaattnttttcgacttagtttacttactggtacagtactaataactaacaagtcgacctattctaccgtttcggacccgtaagggaaccaaagtggaatacgtacaaacgacgtagtggctagacactatctcttactctactccgttccacctatccgtagacgtactaacg

SEQ ID NO: 345312 - DNA, 627 bp, Homo sapiens
  misc_feature: GZ8MTXP02F2IUU.15.8.A08.1.454.CMB.2.raw
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaaccaacagaaacctggccagccctcccaggctcctcatctatgctgcatccagttagggacacgtggtaactcccagccaggttcaggtggcaggtgggtctggcanagagttccactcctcaccatcagcacgccccgngagtctagaaagttnttttagacttagtttacttactgtacagacaaataactaaacgaagtcggacctagttctaccgtttacccggacccgaaacggggtaacccaaaaggttggaaattaaactaaccgaaaaacgtaaacgttacggtacgggtcctaggaccctaaacctaactttaccgtttacgtttctttaccttaaccttcccgtttcccccggtaaccctaacgtttcgtaacgtaacggtcctttaaaacccgg

SEQ ID NO: 345313 - DNA, 633 bp, Homo sapiens
  misc_feature: GZ8MTXP02HIFAJ.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcaggccagtcagagagttgccgctagtttagcctggtaaccaacagaaacctggccaggccctccgaggcctcctcatctatgctgcatccaagttagggactacgtcggtactcccagccgtaggttcaggttcggcgtagggttcgggtctggaccacgtaggtacttccccacgtcctacacctatccagccgaccgcccggactaggttcctaggtaaacgtttacgtttacgtaccttagttttaacttaccgttagttacccaagactaaacgttaaataaacgtaacgtacgtaccttaacgtttacctaccggttttaccgacccgtacgggaaacctaaggtacggaatactaacgaaaccgtaattgacggtctacgtactactacttctcttacttctacttccgttaccccacgtactacgtacgtacgtacgtacg

SEQ ID NO: 345314 - DNA, 510 bp, Homo sapiens
  misc_feature: GZ8MTXP02FH9WE.15.8.A08.1.454.CMB.2.raw
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcanagagttcccactcncaccatcagcacgccccgnagtctagaagtattttgctagtttatactgtcagcaataataacaagtgcctattcacgtttcgcccagggaccaaaagtgatatacaaaacgactgtacggctcgcacctatctcgttccttcacttccttcccgctactcctagacgcttacgg

SEQ ID NO: 345315 - DNA, 551 bp, Homo sapiens
  misc_feature: GZ8MTXP02JFW2J.15.8.A08.1.454.CMB.2.raw
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcagggccagtcagagagttgccgcctagtttagcctggtaccaacagaaacctggcccagcctcccaggctccctcatctatgctgcatccattagggacatggtactccagccagttcagtggcaggtgggtctggacacgagtacgttccacttctcaaccatccagcacgccccgnagtctagaagtntttgctagtttattactgtacagtacaatataacaagtcgacctattccaacgtttccggacccgagggtaacctaaaggtacgtaataactaacgaaacggactcgtagactgaccactacttcgtcgttcttacacttccttccccgactacgtcgtacgtacgtacttaacgg

SEQ ID NO: 345316 - DNA, 660 bp, Homo sapiens
  misc_feature: GZ8MTXP02GSN3E.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctctcatctatgctgcactccagttagggacacgtggtactcccagtcccgtaggttcagtggcaggtgggtctggacacagacgttcccactcctcacctatccgacgccgacgcccccgatacgttcctagtaaagttgtttttgacgttaaggttttaacttacgttacggtccttaaggactaaattaaacgtaaacgtaaaggtcggtaccctactttacctaccgttttacccgggacccgtaacggggtaacccgtaaaaggtagggtaacttaactaaacgtaaacgtaaaccgttaggtacggtcgttacggaccaaacctacgttacccttgtttacctttaccttaaccttttccccgtacccttacttcgtacggtacgtaccgtttaccgttaacgg

SEQ ID NO: 345317 - DNA, 672 bp, Homo sapiens
  misc_feature: GZ8MTXP02G3UE8.15.8.A08.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcgaggccagtcagagagttcgccgccagtttacgcctggtaaccaaacacgaaaccgtcggaccagccctcccgaggcctcctcatctatgctgcactcctagtaggacactggtacnccagcctaggtcaggtcgcgtaggtcggtctggacacaggtacttccactcctacacctancagccgaacgcccgactaacgtctagtaaagttactttcgacgttaagtttacttacgtagtacccgtaagtaacctaaaagttaaactaaacgtaacgtacggtaccttaatttaccgtaacccgtttaccgggacccgtaacgggtaaaccgaaaggttacggaaactaaacgtaacgtaaaacctaaacgtcggtacggtactacggtaccaacccttagttaccgtttacgttcccttaaccgttaccttaacccggttccccgtaccgtacttaccgtacgtaccgttaaccgttaaacccggg

SEQ ID NO: 345318 - DNA, 810 bp, Homo sapiens
  misc_feature: GZ8MTXP02F7LDI.15.8.A08.1.454.CMB.2.raw
  modified_base (172)..(172): a, c, t, g, unknown or other
  misc_feature (172)..(172): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagcccaccctgtctgtcgtcgtaccgggggaaancgcccaccctctcctgcagggccagtcgagagtgccgctacgttagtccgtcgtacaacaacgaaccgtacggcaccgcctcccacggtctcctcactctatcgtctcgcactcctacgttaacgggtacaccgttacggtacgtaccccacggtcctacgggttacgtacggtcgggtaccgagggtttcggggtccggttacggacgtaacgaacgtaacggtttcctaccctccctacctaccaacgttacgacgacccgtcggggtacccccaaccggttgttaaccgttaacgggtacgtttaaacgtttttcgttacgtttaacgtttttaaacgttactttacgggtactaaacgtaaacgttaaaattaacgtaaacgtaaaaccggttcggtacccttaaacgttttacccgttaccggttttaacccccggggaaccgtaaaccgggtaaaccgggtaaaaggtagggttaactaaaacgttaacgaaaacggtaacggtacgtttacggaccgttacggtaccttaaaccaccggttttactaccgttttaaccttcccggtaacttttccccgtaaccccgtaccgtaactttcccgaaggtactaccggggtaacctttaacggg

SEQ ID NO: 345319 - DNA, 638 bp, Homo sapiens
  misc_feature: GZ8MTXP02HNPGM.15.8.A08.1.454.CMB.2.raw
  modified_base (416)..(416): a, c, t, g, unknown or other
  misc_feature (416)..(416): n is a, c, g, or t
  modified_base (589)..(589): a, c, t, g, unknown or other
  misc_feature (589)..(589): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaagagccaccctctcctgcagggccagtcagagagttcgccgcctagtttacgcctggtaaccaacaacgaaacctcggaccagccctcccaggcctcctcactctatcgctcgcactccgtagtacggacacgtggtactcccgagacctacggttcaggtcgggctagggttcgggtctcggcacgagtacgttaccactctaccaccactaccagccgaacgccccacgtacgtctagtaaacgtttntttacgacttaagtttattacgttgtacagtactaaattaaacgtaaactaaggtcgtaccttacgtttaccttaaccggttttacccggacccgtaacgggtaaacccgtaaaggtacgaaattaacgtaacgaaaacgtaccgtgtaacggtctacgaccactacttcctnttcctactacctcccgtccgtactactacgtacgtacgtacgtaaccgg

SEQ ID NO: 345320 - DNA, 701 bp, Homo sapiens
  misc_feature: GZ8MTXP02F3TCO.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttcgccgcctagtttacgcctaggtaccaacagaaacctggccagccctcccaggcctcctcatctatgctgcactcctagttacgggacacgtggtactcccagcctaggttcaggtggcgaggtcgggtctggacagtagtacgttccccacctcctaccaacctactccgaacgccaaccggcccccgacgtacgttaccgtaaggtaaagttagttttacggactttaaacggttttacttaacgttacggttaacaacgtaacctaaaagttaaactaaacgtaacggttaccggtaacccttaacgtttaccgttaacccggtttacccgggaaccccggttaaacgggggtaaaccctaaaagggttggtaaaacttaacgtaaaaccgaaaaccgtacgttggtacggtactacgacctaacccttattaccgttacttaccgtacttaccttcccgtacccgactacttcgtacggtacgtaccgtaacgg

SEQ ID NO: 345321 - DNA, 590 bp, Homo sapiens
  misc_feature: GZ8MTXP02GI8WC.15.8.A08.1.454.CMB.2.raw
  modified_base (400)..(400): a, c, t, g, unknown or other
  misc_feature (400)..(400): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagccaccctctcctgcaggccagtcagagagttgccgccagtttacgcctggtaaccaacagaaacctggccagccctcccgaggcctcctcatctatgctgcatccagttaggacacgtggtactcccgagccgtaggttcaggtggactagggttcggggtctggccaacgagtacgttcccacttctacaccatccagccacgccccgagtagttctagtaaacgttntttgacttagtttacttacgtgtacagactaaataagtaaacgtagtcgtacctacttaccgtacgtttccggacccgtaagggaacctaaaggtagtatactaacgaaacgtagtgtcgtactacgaccacgtattcgtcgttcttactacttcccttcccgactacgtctacgtacgtacgttaacgg

SEQ ID NO: 345322 - DNA, 597 bp, Homo sapiens
  misc_feature: GZ8MTXP02G2IFG.15.8.A08.1.454.CMB.2.raw
  modified_base (169)..(169): a, c, t, g, unknown or other
  misc_feature (169)..(169): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (372)..(372): a, c, t, g, unknown or other
  misc_feature (372)..(372): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagcccaccctctcctgcagggccagtcagagagttgccgcagtttagcctgtaccaanagaaacctggccagcctccagctcnatctangctgcatcagtaggactacgtgtacncccagccgaaggttcaggtgacagggttggtctggaccanagtagtcccactctacactgacaagcacgtccatagtctagtaagttntttagcgttatttaatcgttgactagacaataataaacgtagcgtaacctatttaccgtacggtttaccgaccgtaacgggaaaccaaaaggtaggtaattaacgtaaaccgaaaacgttaacggtttgccggtaacttcggaaacaaccgttcttaccgttacgttaccttacctaccgttaaccccgtacccgacttactacgtacgaccgttacgtaaacgg

SEQ ID NO: 345323 - DNA, 719 bp, Homo sapiens
  misc_feature: GZ8MTXP02JZT4J.15.8.A08.1.454.CMB.2.raw
  modified_base (168)..(168): a, c, t, g, unknown or other
  misc_feature (168)..(168): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaanacgcccaccctctcctgcagggccagtcagagagttcgccgcctaagtttacgccgtggtaacccaaacaacgaaaccctcggacccagcccctacccgaggtcctcctctatctatcgactgactactcctaagttacgggactacgtggtactccgagtccgtaggttcgagtggacagggttcggtctaggctaacgtaggtactttccccacttcctaccaacctactccgacgcccgaaccgccccgtactagttacgtaggtaaaagtttgttttaccgtagtttaacgttttaacttaccgtaggtaacctaagtaaccttaaaagttaaaacttaaacgtaacggttaccgtaccttaagtttacccgttacggtttaccggaacccggtaaacgggaaaccgtaaaaggtcggtaaacgttaacgaaacgaaaccgtaacgtggtaacgtccgtacgtaccaaccgttacttcgttaccgtttaccttacctacctttcccgtacccccgtattacttccgtagtaccgttaacgttaacgg

SEQ ID NO: 345324 - DNA, 696 bp, Homo sapiens
  misc_feature: GZ8MTXP02F8ZJK.15.8.A08.1.454.CMB.2.raw
  modified_base (169)..(169): a, c, t, g, unknown or other
  misc_feature (169)..(169): n is a, c, g, or t
  modified_base (263)..(263): a, c, t, g, unknown or other
  misc_feature (263)..(263): n is a, c, g, or t
  modified_base (342)..(342): a, c, t, g, unknown or other
  misc_feature (342)..(342): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcagggccagtcagagagttcgccgcctagtttagcctggtaaccaacagaaacctggccagccctccgaggtctcctnatctatgctgcatccattacggacacgtgtaactcccaagtcccgtaaggttcaggttcggacgtacggtcggggttcnggaccacgtagtacgtttaccccacctttacctaccaacctaataccgacgccgaccgcccgtagtacgttactaaggtaaagttctttacgtacgtttaaagtttaacgtacgtacgtactagtacgtaagttaagttaacgttaacgttaccgttaccggttacgggtaccgggttaccgggtaaccgggtaaacgggtaaaccgggtaaacgggtaaacggtaaacgtaaacgtaaaacgtaaacggtacggtacggtacgtacgtacgtacgtacgttacgttacgttacttacgtaccttaccgtacccgtaaccgtacgtacgtacgtacgtacgtaacgtacgtacg

SEQ ID NO: 345325 - DNA, 529 bp, Homo sapiens
  misc_feature: GZ8MTXP02JWH8O.15.8.A08.1.454.CMB.2.raw
  modified_base (168)..(168): a, c, t, g, unknown or other
  misc_feature (168)..(168): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagtctacgtagccacgaccggtgctcgatttagcatactctacagggtggctggagacttcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaccaacagaaacctggccagcctcccaggctcctcatctatgctgcatccagttacgggacacgtggtactccccgagcctaggttcaggtggcaggtcgggtctggcacgagcgttcacctctcaccatcagcncgcccgnacgtcagaagtnttttcgacttagtttatactgtacagactaatataacagtcgactattctacttcggaccagggaccaaagtgaatactacgaaacgtactgtacgctcgacacctatcgtatctacacgttcctaacccgctactctcgactacgtaacgtag

SEQ ID NO: 345326 - DNA, 647 bp, Homo sapiens
  misc_feature: GZ8MTXP02I6ZB1.15.8.A08.1.454.CMB.2.raw
  modified_base (169)..(169): a, c, t, g, unknown or other
  misc_feature (169)..(169): n is a, c, g, or t
  modified_base (229)..(229): a, c, t, g, unknown or other
  misc_feature (229)..(229): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagngccaccctctcctgcagggccagtcagagagttcgccgcctagtttagcctggtaccaanagaaacctggccagcctcccgaggctcctcatctatgctgcatccattagggactacgtggtactcccagccaggttcaggtggactagggttcgggtctggccaacgaggtacgtttcccaccttcctaccaaccatccgagccgtacgcccccgataggttcctaggtaaagtctttttacgactttaggtttattacgtgtactagacctaaataactaacgaacggtcgtacctattaccgtaccgtttaccgggacccgaaggggtaaccctaaaacgggtggaactttaacgaaccgtaaaaccgggtaacttcgggtacggaccttacggactaacccgtattcgttacgttctttaccaacctttcccgtaccccgtaccttacttccgtaagtacgtaccgtttaacgg

SEQ ID NO: 345327 - DNA, 601 bp, Homo sapiens
  misc_feature: GZ8MTXP02FH3LA.15.8.A08.1.454.CMB.2.raw
  modified_base (168)..(168): a, c, t, g, unknown or other
  misc_feature (168)..(168): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaangccaccctctcctgcagggccagtcagagagttgccgccagtttacgcctggtaccaacagaaacctggccagccctcccaggctccctcatctatcgctgcatccagttacgggacacgtggtactccccgagccgtaggttccaggtggactagggtgggtctggcagagtcgtcccactctcacatcgacgcacgcccgngagtctagaatntttagcttagtttatacgtgtacagactaataactaacaagtcgtacctattacctaccgtttccgggaccctacggggaaaccctaaagggtacggtaaactacgtaaccaaaacggtacgtggtacggtactcgaccgtacctaacgttcgtacgttaccttccttaaccgttccttaccccgtactacttccgtacggaccgtacgttaaaccgg

SEQ ID NO: 345328 - DNA, 531 bp, Homo sapiens
  misc_feature: GZ8MTXP02GASH9.15.8.A08.1.454.CMB.2.raw
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaagagccaccctctcctgcagggccagtcagagagttgccgccagtttagcctggtaccaacagaaacctggccagcctcccaggctccctcatctatgctgcatccattaggacactggtactcccagcctaggttcagtgcagtgggtctggcacagagttccactctcacatcagcagcccnagtctagaagtatttgntagtttattactgtcagntaaactataaaccgagtcggtacctattacaccgttttcggacccgtaagggtaacccaaagtgaactatacgaaacgaactagtggtactagaccacctactctacgtcttacactccttcccgactactctacgacgactaacgg

SEQ ID NO: 345329 - DNA, 586 bp, Homo sapiens
  misc_feature: GZ8MTXP02IACDL.15.8.A08.1.454.CMB.2.raw
  modified_base (168)..(168): a, c, t, g, unknown or other
  misc_feature (168)..(168): n is a, c, g, or t
  modified_base (257)..(257): a, c, t, g, unknown or other
  misc_feature (257)..(257): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgctagtttagcctggtaccaacagaaacctggaccagccctccaggcctccncatcatgctgcatccagttacggacacgtggactcccgagccctaggtcagtggcaggttggtctgggcacgaggnttccacctcgtcacctatccagcaacgccctnagtctaggattatttgtacgtagtttacttatcggtactagactaataactaaactaagttcgaccttattcctaacgtttccggaccacggggtaacaaaggtaggtaacttaaacgtaacgtaaacgtacgtagtcgtacgtacgtactaacgtacgtaccgttcgttacctttacctaccttcccggtacccacctactacgtacgtacgtacgtacg

SEQ ID NO: 345330 - DNA, 558 bp, Homo sapiens
  misc_feature: GZ8MTXP02II6YE.15.8.A08.1.454.CMB.2.raw
  modified_base (167)..(167): a, c, t, g, unknown or other
  misc_feature (167)..(167): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccggggaaanagccaccctctcctgcagggccagtcagagagttgccgccagtttagcctggtaccaacagaaacctggccagcctcccaggcctcctcatctatgctcgcatccaattagggacactcggtactcccgagccgtaggttccaggttggccaggtggggtcctggggcacgtaggtacttaccacctcctaccgacacgtccaaggcctacgcccgtacngtctagggaaattgtttacncttagtttactactgtacanactaataataactagtacgtactactactacgtaccgaccgacggaacgtaagtagtatactacgaacgtacgtgtgtcgtacgacactactctctctctactcgtccgtacactctcgtacgtacgtacg

SEQ ID NO: 345331 - DNA, 667 bp, Homo sapiens
  misc_feature: GZ8MTXP02GLD35.15.8.A08.1.454.CMB.2.raw
  modified_base (169)..(169): a, c, t, g, unknown or other
  misc_feature (169)..(169): n is a, c, g, or t
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcaggccagtcagagagttgccgccagtttagcctggtaccaacagaaacctggccacgccctcccaggtcctcctcatctatgcctgcatccagttacgggacacgtggtactcccagcctaggttcagtgcgaggtggtcnggcagagtgtcccactcncaccatcacgcacggccccngtacgtctaggtaaagttactttgtacttaacgttttaattaccgttgttaccgaagtacctaaaattaaactaaacgtaaaggttcgtaccttactttccgtaaccgttttacccgggacccggtaacggggtaaacccgtaaaaggtaggtaaacgtaaacttaaccgtaaaaccggtaacgttgggttaccgaccgttacggacctaaccgtacgttaccgtttacgtttcctttacctaacctttcccgtttcccccgtaaccgtctttaccggtacggtaccggtaccctttaaacgg

SEQ ID NO: 345332 - DNA, 558 bp, Homo sapiens
  misc_feature: GZ8MTXP02FZGQA.15.8.A08.1.454.CMB.2.raw
  modified_base (169)..(169): a, c, t, g, unknown or other
  misc_feature (169)..(169): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttcgccgcctagtttagccttggtaccaaacagaaacctggcccagccctccaggcctcctcatctatgctgcatccagttacgggactacgtggtactccccagcctaggttcaggtgctaggtggtctggcanaggtattccactctacactncagcacgtcccgnacgtctagatatttgactagtttatactgtcagctaaatactaacaagtcgtactattactaccgtttcgacccgaagggaacctaaagtggaatacgtacgaaacgtaacgtgtggactagaccacacgttctactcttcctaacttcccttacccggactacgtccttagaccggtacttaaaccgg

SEQ ID NO: 345333 - DNA, 691 bp, Homo sapiens
  misc_feature: GZ8MTXP02GGTQB.15.8.A08.1.454.CMB.2.raw
  modified_base (171)..(171): a, c, t, g, unknown or other
  misc_feature (171)..(171): n is a, c, g, or t
  modified_base (280)..(280): a, c, t, g, unknown or other
  misc_feature (280)..(280): n is a, c, g, or t
tcagtctacgtagccacgaccggtgctcgatttagcatactctacagggtggctggagactgcgtcatcactacttctcttcctcctgctactctggcctcccagataccactggagaagtagtgatgacgcagtctccagccaccctgtctgtgtcgtccgggggaaaangccaccctctcctgcagggccagtcagagagttcgcccgtcctagtttacgcctaggtaacccaaacacggtaaaccctgggaccctagccctacccgaggtcctcctnatcctatgctgcatccagttacgggactacgtggtactccgagtcctaggttcaggtgcgagggtggtctggactagagtagttccccactcctacactactcgacgccgacgacccccggagttacgttcgtaaagggtaacttagtttaccggtagtttaacgttttacgtttaaacgttcggttaacgaacgtaactaaacggttaaataaaccgtaacggtacggtacccttacgtttacccttaacccggttttaccgggacccccggttaaaacgggggaaaccgtaaacgggttaaggaaactaacgtaaacccgtaaaacgtaaacgttcgggacgtccgtacgacctactacgttctacgttctactacgtccgttccgacctactctagtacgtataccgg

SEQ ID NO: 345334 - DNA, 532 bp, Homo sapiens
  misc_feature: GZ8MTXP02JYV2O.15.8.A08.1.454.CMB.2.raw
  modified_base (167)..(167): a, c, t, g, unknown or other
  misc_feature (167)..(167): n is a, c, g, or t
  modified_base (326)..(326): a, c, t, g, unknown or other
  misc_feature (326)..(326): n is a, c, g, or t
  modified_base (499)..(499): a, c, t, g, unknown or other
  misc_feature (499)..(499): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtctccgggggaaancgccaccctctcctgcagggccagtcagagagttcgccgcagtttagcctggtaccaacagaaacctggccagcctccaggctctcatctatgctgcatccgattagggctaactggatcccaagccaggttcagtggacacggtgggtctggacacgngactttcccgactctcacctatccgagcgacgcccggatagtctagaaagtctttgacttagttacttacagtcagtacaagtataacacgtgaccctagtcacttcgactacggaacaagtggactacacaacgtactggtacgtctcgcaacccgtatactcgtacttacnttaaccgtccgctacttacgcgacgtactaacg

SEQ ID NO: 345335 - DNA, 735 bp, Homo sapiens
  misc_feature: GZ8MTXP02GTJKS.15.8.A08.1.454.CMB.2.raw
  modified_base (170)..(170): a, c, t, g, unknown or other
  misc_feature (170)..(170): n is a, c, g, or t
  modified_base (268)..(268): a, c, t, g, unknown or other
  misc_feature (268)..(268): n is a, c, g, or t
  modified_base (308)..(308): a, c, t, g, unknown or other
  misc_feature (308)..(308): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtaccgggggaaancgccaccctctcctgcagggccagtcagagagttcgccgctagtttagccgtaggtaaccaacagaaaccctggcccagccctaccgaggcctccctnacgtctatcgctgcacgtcctagttacggacacgtgtacnccgagtccaaggttcaggtcggacgtaggtcgggttcacggacaagtacggtactttaccccactctaccgaacctagacgaacgccgaaccgcccccgagtagttccgtaaacggtagttagttttacaccgtttaaaggtttttaactacggttattacccgaagtaactaaaactttaaagaaaaccgtagggttacccgtaacttaactttacccgttacgggttttaaccccgggaacccgtaaacgggggttaaaccaaaaggttccgggaaaatttaacaaaacccgttaaaaggaaccggtttgtaaccggggacgttaacccgaccctaaacggtttaaactccgtttagttaaaccttcttaacggttcccccgttacccctaatacggtttccacgggtattacccgttaaaacgg

SEQ ID NO: 345336 - DNA, 928 bp, Homo sapiens
  misc_feature: GZ8MTXP02JB8YO.15.8.A08.1.454.CMB.2.raw
  modified_base (341)..(341): a, c, t, g, unknown or other
  misc_feature (341)..(341): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagcccaccctctcctgcagggccagtcagagagttcgccgctagtttacgcctggtaaccaacagaaacctggccagccctcccgaggtcctcttatctatgctgcactccagttacgggactacgtggtactccccgagcctaggttccaggtggcgtaggtgggttaccnggtaccagtagtacgtttaccaccccttctaccgacctactaccgacgccaccggcccccgtacgtaaggttcccgtaacggtaaagtttacgtttttacggtacccgttaagtttttttaaacgttaaccgttcgggttaacccaaaggttaccctaaaaaatttaacgtttaaaaaacccgggtaacggggtttaccccggttaaacccctttaaacgttttaccccgttaaaacccgggtttttaccccccgggggaaacccccggtaaaaccgggggttaaaaccccgggttaaaaaagggttcccggggttaaaagttttaaaacccgaaaaccccgttaaaaacccgggttaaaacccggtttgggggtaaccgggtaacccgtttaccggggaaaaccccctttaaacccccgtaaagtttttcccccgggtttaaaacgttttcccccgttttaaaacccgtacccgtttttcccccccggttaaaacccccccgggttcccccgtttaaaccgtttcccggtttaaaaccggtacccggtttaaacccgggtttaaaacccgggtttaaacccggggg

SEQ ID NO: 345337 - DNA, 550 bp, Homo sapiens
  misc_feature: GZ8MTXP02GIBSV.15.8.A08.1.454.CMB.2.raw
  modified_base (168)..(168): a, c, t, g, unknown or other
  misc_feature (168)..(168): n is a, c, g, or t
  modified_base (230)..(230): a, c, t, g, unknown or other
  misc_feature (230)..(230): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctggtaaccaaanagaaacctggccagccctcccaggctcctcatctatgctgacatccaagttacgggacactggtactcccagccaggttcagtggacaggtgggtcaggcataggnttccactcncacctancgancacgccgatagtcagtaagttntttcgattagtttattagtgtanagataataataacgtaagtacgtacctattaccttacgttaccgaccgaacggaacgaaagtagtaagtaataacaaacgtaacgtagtgtcgtacgacactactctcttctctactcctccctacctactacgtcgacgtacgtaacg

SEQ ID NO: 345338 - DNA, 563 bp, Homo sapiens
  misc_feature: GZ8MTXP02GPQYZ.15.8.A08.1.454.CMB.2.raw
  modified_base (168)..(168): a, c, t, g, unknown or other
  misc_feature (168)..(168): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (454)..(454): a, c, t, g, unknown or other
  misc_feature (454)..(454): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgccagtttagcctggtaaccaacgagaaacctggccagccctcccaggctcctcatcatgctgcatccattaggcactggactcccagccaggttcagtgcaggtggtcngacagagtatcccactctcaccatcagccagcccgtanagtcagtagttatttgacttagtttatactagtactagtactaataataaacagtcgactacttcgtacgttccgaccggaaggtaccgaaaggtcgtaanaacgtaacgaacgtaacgtacgtacgtacgtacgacgtacctacttacgttcgttaccttacctaccgttccgttacccgtaccgtacgtacgtacgtacgtacgtacg

SEQ ID NO: 345339 - DNA, 609 bp, Homo sapiens
  misc_feature: GZ8MTXP02GM07T.15.8.A08.1.454.CMB.2.raw
  modified_base (169)..(169): a, c, t, g, unknown or other
  misc_feature (169)..(169): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttcgccgcctagtttagccgtggtaaccaacagaaacctggaccacgcctcccaggcctcctcatctatgctgacactccgattacggaactacgtggtactcccgagccctaggttcaggtggctaggtgggtctggcacgagtcgttccactctcaccntcagccacgcccgnagtcagtaagttatttgacttagtttactactgtcagactaataactaaacgtacgtacggaccttacttaccgttaccggttttaccgggaaccccgtaaacggggtaaacccgtaaaggttacgggtaacttaacgtaaacgaaaacgtacgttacggtcggactcgacctactacttctacgttcctactactcccgttacccgactactcgtacgtacgtacgttaacg

SEQ ID NO: 345340 - DNA, 732 bp, Homo sapiens
  misc_feature: GZ8MTXP02GVNNG.15.8.A08.1.454.CMB.2.raw
  modified_base (167)..(167): a, c, t, g, unknown or other
  misc_feature (167)..(167): n is a, c, g, or t
  modified_base (392)..(392): a, c, t, g, unknown or other
  misc_feature (392)..(392): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccacctgtctgtgtcgtccggggaaangccaccctctcctgcagggccagtcagagagttgccgctagtttacgcctggtaccaacagaaacctggaccagccctcccgaggtcctcctcgattcatgctgcactccaagttaggactacgtggactacccagtccgtaaggttcaggtcgggacagggttcggggtactcggactacgaggtacttacccactctaccacaatccaacgcacgccccgganaccgttctaggaactttacgtttagtccttaaggttttacttaacgttgtactaagtacccaaaagtttactaaaacgtacgtacgggtacctaacggtttaccttaacccggttttccgggaaccccgaacgggggttaaaacccgtaaaacggtttaggtaaacgtttaacggttaaaccaaaaaccggtttaaccgttagggggtaccggtttactaccgggaaaccttacccggtaaacgttacgttcccgtttaacttttccctaaaccggtttccccgttcccccgtacgtttaaaccgtaccggttaacggtaaccggttacggttaaaccgg

SEQ ID NO: 345341 - DNA, 536 bp, Homo sapiens
  misc_feature: GZ8MTXP02IQZVH.15.8.A08.1.454.CMB.2.raw
  modified_base (169)..(169): a, c, t, g, unknown or other
  misc_feature (169)..(169): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
tcagtctacgtagccacgaccggtgctcgatttagcatactctacagggtggccggagactgcgtcatcactacttctcttcctcctgctactctggctcccagataccactggagaagtagtgatgacgcagtctccagccaccctgtctgtgtcgtccgggggaaanagccaccctctctgcagggccagtcagagagttgccgctagtttagcctggtaaccaacagaacctggccacgcctccaggctcctcatctatgctgcatccagttagggacactaggtactcccagccaggttcagtggcnggtgggctgcanagagttcacctcncacatcaagcncgcccgcaggtcngaaagtnttttgactagtttattactgtcagactaataataactaaagtgactattcgtactttccggacccgtagggaccgaaagtgaatatacgaaaacgtactagtaggctcgacacctactctacgttcttacctacttccttcccgcctactccgtgactacgtacgtaag

SEQ ID NO: 345342 - DNA, 714 bp, Homo sapiens
  misc_feature: GZ8MTXP02I0NAS.15.8.A08.1.454.CMB.2.raw
  modified_base (169)..(169): a, c, t, g, unknown or other
  misc_feature (169)..(169): n is a, c, g, or t
  modified_base (452)..(452): a, c, t, g, unknown or other
  misc_feature (452)..(452): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccaccctctcctgcagggccagtcagagagttcgccgctagtttacgcctacggtaccaacacgaaacctggcccacgccctcccgacggtcctccctacatctatgctgctactccgaagttacgggacctacgtaggtacctacccgacgtccgtaacggtttccgaggtcgggcgtagggttcgggttccgtaggaccagtaggtacgttccccaccttcctaccaacccgtataccgacgccgtacgcccccgagtacgttccgtaaggtaaacgttntttacgatttagtttactacgtagtacgaagtacttaaaagttactaaaccgagtccgaacctttacgttacccgttaacccggtttaccgggaaccccgtaagggtaaaccctaaaggttacgaattaaccgttaaacgaaacgttacgttcgggacgtaccgtagaccctaaacggttctttaccggttcgttaaacccttcctaacccgtttcccgttacccgtacctagttacccgtggtaacgttacgtttaaacgg

SEQ ID NO: 345343 - DNA, 515 bp, Homo sapiens
  misc_feature: GZ8MTXP02ITZY4.15.8.A08.1.454.CMB.2.raw
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (446)..(446): a, c, t, g, unknown or other
  misc_feature (446)..(446): n is a, c, g, or t
  modified_base (478)..(478): a, c, t, g, unknown or other
  misc_feature (478)..(478): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagccctcccaggctccctcatctatgctgcatccattagggacacgtggtactcccagcccaggttcagtggcaggtgggtctggcacagtagttcccactctcaccatcagcacgcccgnagtctagaagtntttgctagtttattactgtcagacaatanaacaagtcgactattcactttcggacccagggaccaaagtgatanacaagactgcgactgacactatcgtactcttnacttccgttacccgcctactcgtacgacgtactaacg

SEQ ID NO: 345344 - DNA, 653 bp, Homo sapiens
  misc_feature: GZ8MTXP02GD2VE.15.8.A08.1.454.CMB.2.raw
  modified_base (169)..(169): a, c, t, g, unknown or other
  misc_feature (169)..(169): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaangccaccctctcctgcagggccagtcagagagttcgccgcctagtttagcctaggtaccaagagaaacctggccacgccctcccgaggtcctccctcatctatcgctgacatccgagttacggactacgtggtactcccgagccgtaggttcaggttggcgtaggtgggtcctggaccacgtagtacgttcccacgtctccaccatccgaagccgacgtccccggtagacgttcgtaaggtaaacgttacgttttacgtacgtttaacgttttaattaaccgttggtaaccctagaccttaaataaacgtaaaccgtagtaccggtaccttacgttacctacggtttacccggaccgaaacggggtaaccctaaagggtcgaacttaacgtaaccgaaacgtacgttggcgtcacgactaccttatcgttacttccttacctacgttccccgtcccgtactactcgtacgacggtaccttaacgg

SEQ ID NO: 345345 - DNA, 664 bp, Homo sapiens
  misc_feature: GZ8MTXP02FZVW4.15.8.A08.1.454.CMB.2.raw
  modified_base (136)..(136): a, c, t, g, unknown or other
  misc_feature (136)..(136): n is a, c, g, or t
  modified_base (168)..(168): a, c, t, g, unknown or other
  misc_feature (168)..(168): n is a, c, g, or t
  modified_base (431)..(431): a, c, t, g, unknown or other
  misc_feature (431)..(431): n is a, c, g, or t
  modified_base (594)..(594): a, c, t, g, unknown or other
  misc_feature (594)..(594): n is a, c, g, or t
  modified_base (600)..(600): a, c, t, g, unknown or other
  misc_feature (600)..(600): n is a, c, g, or t
  modified_base (616)..(616): a, c, t, g, unknown or other
  misc_feature (616)..(616): n is a, c, g, or t
  modified_base (644)..(644): a, c, t, g, unknown or other
  misc_feature (644)..(644): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtcnccagccaccctgtctgtgtcgtccggggaaancgccaccctctcctgcagggccagtcagagtagttgccgcctagtttacgcctagggtaacccaaacgacgtaaaccgtcggacccacggtcccctcccgaggtcctcccgtccattctatcgctgcctatcccgtagttacgggacctaatcggtacctcccgagccgtaggtttcaggtcggcgtagggttcgggtactgggacaacgtaggtacgttcccacctcctacacctataccgacgggccaacggtcccccganacgttacctaggtaaaagttctttttacgactttaagtttttaccgtattcggtaactaacgtactaaaagtttaacgaaacgtacgggtctacctagtttacccgtacgttaccggaacccgtaggggaaccctaaggtagtactagtaacgaaacgttagngtaacnctcgaccagttacgtntacgttcttcaccgttccctaacccgtntacgtgactacgtacgtacg

SEQ ID NO: 345346 - DNA, 610 bp, Homo sapiens
  misc_feature: GZ8MTXP02J0OGR.15.8.A08.1.454.CMB.2.raw
  modified_base (169)..(169): a, c, t, g, unknown or other
  misc_feature (169)..(169): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanagccaccctctcctgcagggccagtcagagagttcgccgcctagtttagcctaggtaaccaacagaaacctggccagcctcccaggctcctcatctangctgcatccagttacgggacacgtggtactcccgagcctaggttcagtggacaggtggtcnggacacagtacgttccactctacacatccgagccgacgtcccccgatagttcctaaggtaaagttattttcgacttaagttttacttacgttgtacagtactaaattaataaacgagtcgacctatttcctacgttaccggacccgtaacgggaaacctaaaggtggtaaactaacgtaaaccgaaaaccgtaacgttggtacggacttacggacctaacccgtagttcctcgttaccttccaacttcccgttcccgactacttccgagaccgtacgtaacg

SEQ ID NO: 345347 - DNA, 711 bp, Homo sapiens
  misc_feature: GZ8MTXP02F9CMY.15.8.A08.1.454.CMB.2.raw
  modified_base (168)..(168): a, c, t, g, unknown or other
  misc_feature (168)..(168): n is a, c, g, or t
  modified_base (417)..(417): a, c, t, g, unknown or other
  misc_feature (417)..(417): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtacggggaaancgccaccctctcctgcgagggccagtcagagtagttcgccgtcctagtttacgcctacgggtaaccaaacgacgtaaaccgtggacccagcccctacccgaggtccttccctcaattcctatcggctcgcactacctaggttacggacctacgtggtaacctcccgagtccctaggttccaggttcggaccgtagggttcgggtctcggactaaccgaggtcgttaccccaaccgttcaccgtacctanacccgtagccgacgtcccccggtatacggtactaaggtaaactttgtttacgatttaacgtttacacgttcgtacactacgtaaattaacgaagtacgttgaccgttacttaccgtaaccgtttccggaccgtaacgggaacgttaaaggtgtaacgttactaaaccgaaaggtccgttaagtccggtacgtaaccgacctaaaccgttacgttcggttaccttaccgtttccgtaaccctttccggtaccccctattacggtaccgttacgtaaccggttacgtttaaaccgg

SEQ ID NO: 345348 - DNA, 730 bp, Homo sapiens
  misc_feature: GZ8MTXP02FLP72.15.8.A08.1.454.CMB.2.raw
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccggggaaagacgccaccctctcctgcgaggccagtcagagagttgccgcctagtttacgcctacggtaccaacaacgaaacctcggaccagccctcccgaggcctcctacatctatgctgcctactccgtaagttacggactacgtgtacctccgagccgtaggtcaggtcggctagggtcggtcgtggacagtagtgtcccacctctaccaccatccgaagccgtaaccggccctacgtacgtacgttaaggtaagtttcgttttagactttaagttttacttaacgttgtaacgtagaccttaaaagttaaacgtaaacgtaaggttaccggtaacctttaccgtttaacccgtacccggtttacccgggaccccgggtaaaacggggtaaacccgtaaaagggtacgtaaacgttaacctaaaccggtaaaaaccgtacggtacgggttaccgtaacgtaccgtaccctaacccttaacggttccgtttaccgttacccttaccgttaacccgtttcccttaccccgtaccggtactttaccggacgtaccgtacggtttaaacccgg

SEQ ID NO: 345349 - DNA, 753 bp, Homo sapiens
  misc_feature: GZ8MTXP02HOXOQ.15.8.A08.1.454.CMB.2.raw
  modified_base (168)..(168): a, c, t, g, unknown or other
  misc_feature (168)..(168): n is a, c, g, or t
  modified_base (178)..(178): a, c, t, g, unknown or other
  misc_feature (178)..(178): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctntcctgcaggccagtcagagagttgccgccagtttagcctggtaccaacagaaaccctggaccagccctcccagggccctcgtacatcctatcgctagcctataccagttagggcctaagtggtaacctcccgaagcccgtaggtttacaggtcggcctaagggttcggtcgtgggacctacgagtacgttccccaacctcttaccacctattaccaagtccgacgaccccctgtaccgtacgttacgaaagtttcggtttaccacggttacgttttaaactccgttagttacccgaagtaccttaaactttaaagtaaacccgaaggttaccggtaccgttaaactttacccgtttaacccgttttacccggggaaccccgtaaacgggggtaaacccgtaaaaggttccggggtaaagttacctttaaaccggaaaacccggtaaccgttacggtggggtttaaccgtaccggtaaacctaccgttacgtttaccgttacgttacccgttaccttaccgttaacccgttacccgtacccgtaccttaccgtaccggtaaccgttaccgttaacg

SEQ ID NO: 345350 - DNA, 601 bp, Homo sapiens
  misc_feature: GZ8MTXP02GRZ5T.15.8.A08.1.454.CMB.2.raw
  modified_base (375)..(375): a, c, t, g, unknown or other
  misc_feature (375)..(375): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaagagcccaccctctcctgcagggccagtcagagagttgccgcctagtttagcctggtaaccaacagaaacctggccagccctcccaggcctcctcatctatgctgcatccagtaggacacgtgtactccagccaggttcagtggcaggtggtctgacacgagtacgtcccactctacacactcagcgacgcccgcagtctgaaacgtntttagcttagtttacttactgtacagaactaataaagtaaacgagtacgtacctactttaccgtaccgtttaccgggacccgtaacgggaacccgtaaaaggtacggtaaataacgtaaccgtaaaacgtaacgttacggagtccgtacgtaccaacccgttataccgttacgttacttacctaacttcccgttaacccctctactcgtacgtacgtacttaacgg

SEQ ID NO: 345351 - DNA, 655 bp, Homo sapiens
  misc_feature: GZ8MTXP02GB4FJ.15.8.A08.1.454.CMB.2.raw
  modified_base (168)..(168): a, c, t, g, unknown or other
  misc_feature (168)..(168): n is a, c, g, or t
  modified_base (334)..(334): a, c, t, g, unknown or other
  misc_feature (334)..(334): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaanagccaccctctcctgcagggccagtcagagagttgccgcctagtttagcctaggtaaccaacagaaacctggaccagccctcccaggctcctcatctatgctgcatccagttacgggacagtggtaactcccagcctaggttccaggtggcaggtcggtctggcanagtgttacccactctcaccatccaagccgacgcccgagtacgtcgtagtaaacttgtttagtacttaagtttacttaacgtggtacgaacgtactaattaaacgtaaaccgtaagtacggtacccttaacttaccgttaccgttttacccgggaccccggtaaacgggtaacccgtaaaaggtaccgggtaataacgttaaaccgaaaaccgtaacgtacggtgtaccggtacgaacctacccgtaacttaccgttacggttaccttcgttaaccttcccgttaaccccggcttactccgttacggactacgttaaaccgg

SEQ ID NO: 345352 - DNA, 657 bp, Homo sapiens
  misc_feature: GZ8MTXP02JVHJN.15.8.A08.1.454.CMB.2.raw
  modified_base (169)..(169): a, c, t, g, unknown or other
  misc_feature (169)..(169): n is a, c, g, or t
  modified_base (380)..(380): a, c, t, g, unknown or other
  misc_feature (380)..(380): n is a, c, g, or t
  modified_base (432)..(432): a, c, t, g, unknown or other
  misc_feature (432)..(432): n is a, c, g, or t
tcagtctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtcgtccgggggaaanacgccaccctctcctgcgagggccagtcagagagttcgccgcctagtttagcctaggtaaccaacacgaaacctggaccagccctcccaggcctcctcatctatgctgcatcctagttacgggaccactggtactcccgagccgtaggttcaggtggcaggtgggtctggcacgagacttccactctacaacctatcagccacgccccganacgtctaagtacttagtttcgacttagtttacttacgtgtacagacaattanaaacgagtcgacttattacctaccgttaccggaccgaaggggtaaccctaaaaggtcggaaacttaacgtaaccgtaaaacggtaccgttacggtacggtccgttacgacccgtaacccgttacggtttaccttcggtttaaccctttacccgttaacctttcccccggtttacccccgacccttaacgtttaccgtacggtaaccggtacctttaaacccgggg

SEQ ID NO: 345353 - DNA, 697 bp, Homo sapiens
  misc_feature: GZ8MTXP01EH7J0.3.85.H08.1.454.CMB.2.raw
  modified_base (312)..(312): a, c, t, g, unknown or other
  misc_feature (312)..(312): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtcttttcttgtggctatttcaaaggtgtccagtgtgaggtgcgaggtggtggagacgtgggaggaggcttgatccgaggccggtgggggtccctgagactctcctgtgcacgcctctggcttcaccgtcagtagcagctacatgcacgtcggggtcccnccgaggtcctacccggaagggggacggggctgggagtgggtctaccgtagtttattaacattcgtaacgtaccaactactacctacccgtcccggaccccgtagggaaacgggtaccctaatttaacccacttaccgtacccgaaggaacgtaaccgtaactttacccggaaacgtaaaccgaccgggttattaacttaccttaacgtaaaacgttcggaaaacctaacccggtaggaacggaaccgacccgaaaccggtaccgtaccggttaccgttttaataacgtgggtagcggtaaagttgtaacgttcgggacgggttcggggttacccgggtaaccctccgtaacccgttggttaccttacgttccggttaattccggg

SEQ ID NO: 345354 - DNA, 592 bp, Homo sapiens
  misc_feature: GZ8MTXP01EGIH3.3.85.H08.1.454.CMB.2.raw
  modified_base (265)..(265): a, c, t, g, unknown or other
  misc_feature (265)..(265): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtgggggagcttggtacagccgtggggggtccctgagactctcctgtgcagcctntggattcacctttagtaattatgccatgagcgtgggtcccgccaggcctaccgaggggaagggctgggagtgggtctcagctattacgtgatcggtggtaggtaaacacaatactacgcacgacgtccggtaggaacgggcccgtcttaccaccatcctacgaacgagaactaacttaccaaagaaccacgctacggacatctagacaaaagtcgaacacgcctaggacgacgccggaagacgttaccggtacctttagtaccgtgacgttacgaaacccaataccgaacgtaactaacgttaggtaaaccgttaagggttaagggg

SEQ ID NO: 345355 - DNA, 624 bp, Homo sapiens
  misc_feature: GZ8MTXP01CMLKD.3.85.H08.1.454.CMB.2.raw
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtgggggaggcttggtacaggccgtggggggtccctgagactctcctgtgcagcctctggattcagcttcagtgactatgctangcacgtgggtcccnccgaggctccgagggcgaagggggctgggaggtgggtggcctacttatatacataatagaagtaagggaaacgttaaaacgtactaacacgtagtacttccggtgacgaggggcctaattcgaactaatcctaccgaagacgaaccaacctaccaaagggaaccgtaacggttactatctagaactaaagtacgagccaacgccctggccgtaagcccgtagggaaacgggtaaccctacccggttacttcttttaacgtttaaccgtgggtttcgaccgggtaagggttcggttccgggttgggggttaaccggg

SEQ ID NO: 345356 - DNA, 553 bp, Homo sapiens
  misc_feature: GZ8MTXP01D56NX.3.85.H08.1.454.CMB.2.raw
  modified_base (346)..(346): a, c, t, g, unknown or other
  misc_feature (346)..(346): n is a, c, g, or t
  modified_base (530)..(530): a, c, t, g, unknown or other
  misc_feature (530)..(530): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtggggggagcttggtacagccgtggggggtccctgagactctcctgtgcagcctctggattcactttagaattatgccatgagctgggtccgcaggctccgagggaggggctgggagtgggtctcagctattagngtatcgtggtaggtaaaacacgaatactacgcaagacctcggtaggaacgggcccgcttcaccatcctaccaagacgaacaactacccaaagaacacgctggacaattcagacaaaatgaaacagcctagagacgccgaaggacacggtccctttagtactgttagacaaaccaatcgaactanacttaggtaacttaaggtaaggg

SEQ ID NO: 345357 - DNA, 648 bp, Homo sapiens
  misc_feature: GZ8MTXP01CCMJZ.3.85.H08.1.454.CMB.2.raw
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtggtctttttcttgtggcttaattttaaaaggtgtccagtgtgaggtgcagctggtggagtcgtggggggaggtcttggtacaggccgtggggggtccctgagactctcctgtgcagcctctggtattcacctttagtaattatgccatgagtcgtgggtcccgccaggcctaccggagggggaacggggcgtagggaggttcgggtctcgagtcttaagttacgtggtattcggtaggtacggttaaaaaaccacctaattaaccgtaacgcctaacgacccgttccgggtagggaaacggggcccgtcttaccacctatcctacccgaagacgaactaacgtacccaaagaaccacgctacggctatcgtagaacaaagtcgaaacagccgtaggagacggcccggaaggaccttaccggtaccctttagtaacgtcgttacgaccaaaccaatctaaccgtataacgttacggtaaacgttaacgggttaaggg

SEQ ID NO: 345358 - DNA, 707 bp, Homo sapiens
  misc_feature: GZ8MTXP01CFVMU.3.85.H08.1.454.CMB.2.raw
  modified_base (533)..(533): a, c, t, g, unknown or other
  misc_feature (533)..(533): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtggtcttttcttgtggcttaattttaaaaggtgtccagtgtgaggtgcagctggtggaggtcgtgggggaggcttgggtacaggccggttgggggggtcccctggacgactctcctgtcgcacgcctcgtggattctactttaagtaattatcgccatgagtcgtcgggtcccgccgacggccgtaccggaagggggaacgggggtcgtgggggaggttcgggggtctcgagtcttaagtttacggtggtagttcggtagggtacggtaaaaaaccacgtaataaccgtaccggacaacggtaccgttccgggtaggaacgggggtcccctcttaccgaccctagtcctacccgagacgaactaacttaccgaaagaacccncgctacggctaactcacgaactaaacgtcgaaccacgtccgtaggaacggaccggaccggtaacggaacccgttacccggtttaccctttaacgtacgtcggttaccgaaacccttaaaactaactaccgtaacgttaaactaacggttaacggtaaccgttaacgggtaaggg

SEQ ID NO: 345359 - DNA, 682 bp, Homo sapiens
  misc_feature: GZ8MTXP01AU1R4.3.85.H08.1.454.CMB.2.raw
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctggtggagtcgtgggggaggtcttggtacaggccgtggggggtccctgagactctcctgtgcagcctgtggtattcaacctttagtaattatcgcctagtgagtcgtgggtcccgcgaggcctaccggaagggggacggggtctgggaggttcggggtctcgagtcttagttacggtgtacgttcggtgggtacgtaaaaccacgtaataaccgtacgacacgtaccgtcccgggtaggaaccggggtccctcttacccgaacctacttccacgaaggaactaacctaaacttacccaaagaaccacgctacgggactaagttccaggaaacaaacgtcggaaaccacggtacccgtaggacggacgtacccgggaacggtaacccgttaccggttacccttttaagtaccgtggttacggaacccaaacctaagtctaaacggttacaacggttacggtaacgttaacggggttaaggg

SEQ ID NO: 345360 - DNA, 609 bp, Homo sapiens
  misc_feature: GZ8MTXP01ALHKZ.3.85.H08.1.454.CMB.2.raw
  modified_base (287)..(287): a, c, t, g, unknown or other
  misc_feature (287)..(287): n is a, c, g, or t
  modified_base (468)..(468): a, c, t, g, unknown or other
  misc_feature (468)..(468): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtgggggaggcttggtacagccgtggggggtccctgagactctcctgtgcagcctctggattcactttagtaattangccatgagcgtcgggtccgccgaggctccgagggggaggggctgggaggtgggtctcagcttattagtgatcggtggtaggtaaaacactaatactacgcagacctccggtgaacgggcctcttccacctatcctcaagacaactaattacccaaagaaccacgctacggctaattccaanaaacaaagtaacgaacgaacgaccgtacgacggacggaccggaacggaccgttaccggtacccgtttacgttacgttcgttacgaaccgaaacctaactactaacgtaacgtaacgttaacggtaacgttaacggtaaggg

SEQ ID NO: 345361 - DNA, 531 bp, Homo sapiens
  misc_feature: GZ8MTXP02JFTTS.3.85.H08.1.454.CMB.2.raw
  modified_base (365)..(365): a, c, t, g, unknown or other
  misc_feature (365)..(365): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtggcttttctgtggctattttaaaaggtgtccagtgtgaggtgcagctggtggagtctgggggaggcttggtacagccgtggggggtccctgagactctcctgtgcagcctctggattcacctttagaattatgccatgagctgggtccgccaggctccgagggaaggggctgggagtgggtctcagctattagtgatcggtggtggtaacacntactacgcagactccgtgaagggcccgcttcaccatcctccagagacaatccaagaacacgctgcatctgacaaatagaacagcctgagagacgacggacgacgacccgttacttacctgtcgacgaaaccaacacacgtactaactacgtaacgtacgttaaggg

SEQ ID NO: 345362 - DNA, 571 bp, Homo sapiens
  misc_feature: GZ8MTXP02F2ZDD.3.85.H08.1.454.CMB.2.raw
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggcttttctgtggctatttaaaggtgtcagtgtgaggtgcagctggtggagtcgtgggggaggcttggtacagccgtggggggtccctgagactctcctgtgcagcctctggattcactttagtaattatgccatgagcgtgggtccgccaggctccgaggggaaggggctgggagtgggtctcgagctattagtgatcggtggtagtaacacatactacgcaacgctccgtagaacgggcccgacttccaccatcctccgagacacaatcccaaaagacacgctagacctatcctagaccaaaagtagaacacgaccgagagacgacgacggacgaccggtacccttacttaaccgtcgttacgacgaaaccaaacgtactaacgtaactaactacggtaacgtaacggttaaacgggg

SEQ ID NO: 345363 - DNA, 536 bp, Homo sapiens
  misc_feature: GZ8MTXP02I8GJ1.3.85.H08.1.454.CMB.2.raw
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggcttttctgtggctattttaaaaggtgtccagtgtgaggtgcagctggtggagtcgtgggggaggcttggtacagccgtggggggtccctgagactctcctgtgcagcctctggattcacctttagtaattatgccatgagctgggtccgccaggctccgaggggaaggggctgggagtgggtctcagctattagtgatcgtggtggtaacacntactacgcagctcgtgaagggccncttcaccatctccagacgacaatccaaagacacgctgcatctgacaaangaacagccngaagacgcccgaggaccacgggtcccttttaatacctgtacgacgaaaaccaatccaacgtactaacgtacggaactacggttaaggg

SEQ ID NO: 345364 - DNA, 601 bp, Homo sapiens
  misc_feature: GZ8MTXP02I5AXL.3.85.H08.1.454.CMB.2.raw
  modified_base (303)..(303): a, c, t, g, unknown or other
  misc_feature (303)..(303): n is a, c, g, or t
  modified_base (439)..(439): a, c, t, g, unknown or other
  misc_feature (439)..(439): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttctgtggctaattttaaaaggtgtccagtgtgaggtgaagctggtggagtcgtgggggagcttggtacagccgtgggggtccctgagactctcctgtgcagcctctggattcacctttagtaattatgccatgagctgggtccncgaggctccgagggagggctggagtgggtctcagctattagtgatcgtggtagtaacacgatactacgcagtacctcgtaggaacggggcccacttcaccagtcctaccagagacaacttaccaaagacacgcgtnctaatctagaccaaaagtcgaaacacgtccaggaacgacgaccggaggaaccgacgggttacccctttaagttaccgtagttacgaaccgtaaaaccctaatccgtaaacggttactaaaaccgttcgggtaaaaccttaccggggtaagggtttaacgggg

SEQ ID NO: 345365 - DNA, 603 bp, Homo sapiens
  misc_feature: GZ8MTXP02IIN5C.3.85.H08.1.454.CMB.2.raw
  modified_base (349)..(349): a, c, t, g, unknown or other
  misc_feature (349)..(349): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttctgtggcttaattttaaaaggtgtccagtgtgaggtgcagctggtggagtcgtgggggaggcttggtacaggccgtgggggtccctggagctctcctgtgcagcctctggacttctactttagtaattatgccatgagcgtgggtcccgccgaggcctaccgaggggaacggggctgggagtggggtcncgagcttagttacgtgatcggtaggtaggtaaacacgataccgtacgacacgtacctccggtagaaacggggccctaccttaccgacctaactcctacccgaagacgaactaacgtacccaaagaccacgctgcatccagaacctaaagagaacacgacacgagacgacgacgacgaccgtaccttacttactacgtacgtacgaaaccaaactacaacgtaactaaacgtacgtaacgtaacggttaaacggg

SEQ ID NO: 345366 - DNA, 587 bp, Homo sapiens
  misc_feature: GZ8MTXP02JJU8Z.3.85.H08.1.454.CMB.2.raw
  modified_base (176)..(176): a, c, t, g, unknown or other
  misc_feature (176)..(176): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtgcttttctgtggctatttaaaggngtccagtgtgaggtgcagctggtggagtcgtgggggagcttggtacagccgtgggggtccctgagactctcctgtgcagcctctggatcacctttagtattatgccatgagcgtggtccgccaggctccgaggggagggctgggagtgggtctcgagctatagtgatcgtggtaggtaacactatactacggcacgtactccggtagaacggggccctacttccaaccattccctaccgaatacgaactaaacttcccaaaaggaccaccggctacgacactccgtaacgaactaacgtaacgaacgacgacgtacgacgacgacggacggacgtaccgtaccgttacgttacgtacgtacgaacgaactaacgtacgtaacgtacgtaacgtacgtaacgtacggtacgg

SEQ ID NO: 345367 - DNA, 588 bp, Homo sapiens
  misc_feature: GZ8MTXP02HH1JH.3.85.H08.1.454.CMB.2.raw
  modified_base (480)..(480): a, c, t, g, unknown or other
  misc_feature (480)..(480): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtgggggaggcttggtacagccgtggggggtccctggagactctcctgtgcagcctctggattcaccttttagtaattatcgccatgagctgggtccgccgaggcctaccgaggggaaggggctgggaggtgggtctcgagcttagttagtgattcggtggtagtaacacatactacgcagacctccggagaacgggccctcttaccacctatcctcccagacaacaacttaccaaagaaccacgctagctatctagacaaatcgaaacncgacagacgacgaccggaacgaccgtaccgttacctttagtacgtcgtacgaaccgtaaaactaacgtactaaacgtactaaccgtacggtaaacgttacgggtaggg

SEQ ID NO: 345368 - DNA, 694 bp, Homo sapiens
  misc_feature: GZ8MTXP02GR1N0.3.85.H08.1.454.CMB.2.raw
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (543)..(543): a, c, t, g, unknown or other
  misc_feature (543)..(543): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggtctattttaaaaggtgtccagtgtgaggtgcagctggtggagtcgtgggggaggcttggtacagccgtgggggtccctgagacgtctcctgtgcagcctctggattcactttagtaattntgccatgagtcgtcgggtccncgaggcctccggaggggaaggggcgtagggaggttcgggtacctcgagtcgttaagttacgtgtagttcggtgggttacggtaaaccgtaacataccgtaacgaccgaacgtacccgtcggtaggaaacggggtcccgtcctttaccgaccctagtcccttacccgaagaacgactaaacttacccgaaagaaccacggcctagactactcgtagaactaaaacgtcggaaaacncgacgtaggaacgacggacccggaacggtacccgtacccggttacccttttaaagtaccgtacggtaaccgtaaacccgtaaaacctaacgttacccgtaaacgttaaacgtaacgtaaaccgggttaaaccggttaacggggttaacggg

SEQ ID NO: 345369 - DNA, 748 bp, Homo sapiens
  misc_feature: GZ8MTXP02HVEZ6.3.85.H08.1.454.CMB.2.raw
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctggtggagtctgggggaggcttgggtacagcctggggggtccctgagactctcctgtgcagcctctggattcacctttagtaatttancgcatgagcgtcgggtccnccgaggcctaccggaaggggaacggggcgtagggaggttcgggtactacgagtacttaagttacgtagtacgttcggttagggtacgtaaacaactataacgtacgacaagtacctccggtaggaacggggcccgtaccttacccaaccctacgtacctacccgaagtaacgaaacctaaaacgttaacccgaaaagaaaaccaaccggtacctacgactactactacgtaacaaaagtaaacgaaacgaacgaccgtaacggtaacggaaacggaaccggaaccgggaaacccggtaacccggttaaccccgttttaaaccgtttaaaccgttaacgttaccggtaaacccgtaaaaacccgtaaaaccgttaaaccgtaaaaccgttaaaacgtaaaaccgttaaacggtaaaaccggttaaaaccgggtttaaacgggg

SEQ ID NO: 345370 - DNA, 703 bp, Homo sapiens
  misc_feature: GZ8MTXP02GOZ4Y.3.85.H08.1.454.CMB.2.raw
  modified_base (250)..(250): a, c, t, g, unknown or other
  misc_feature (250)..(250): n is a, c, g, or t
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagcgtggtcttttctgtggctaatttaaaaggtgtcagtgtgaggtgcagcgtggtggagtgtgggggagcttggtacagccgtggggggtccctgagactcnctgtgcagcctctggacttcaacctttataattatgccatgagcgtggtccgccaggctccgaaggggaagggctagggagtggggtctcgagctagtgtcgagtgtggtaggtaaacatatactacgcgaagaccttccgaggaaacggcccgtacttcaacccaattcctacccaggaactaacaaaccgttccaaaaaacggaacccaaacgggtctacggtaccgaagtacccttacgggtaaaacgtaaaacgtaaacgtaaaccgtaaccgtaaccggtaacggaacggaacggaacccgggtaaaccgggtaaaccggtaaacccggttaacccgtttaaaccgtttaaacggttacggtaaccgtaaaccgtaaaaccgtaaaaccgtaaacgtaaacgttaaaacgtaaacgtaaacggtaaacggttaaacgggttaacgggg

SEQ ID NO: 345371 - DNA, 664 bp, Homo sapiens
  misc_feature: GZ8MTXP02I8FN4.3.85.H08.1.454.CMB.2.raw
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggtggagtcgtgggggaggcttgggtacagccgtggggggtcccctggagactctcctgtgcagcctcgtggtacttctacctttagtaatttactcggtaccatggacgtccgtcggggtccgcccgaggcctacccggaagggggaacggggtcgtggggtacggtcggggtctacgacgtacttagttacgtgtagtcggtgggttagtaaccactagtacctacgacgagaccttccggagaaccgggcccgtcttacccaccgtatcctcccgaaggacctaactaacgtaccaaaacgtacacggtctcgactacttcagaaccaaatacggaaactaccggtaccagggacgaacggccgtaaaacggacacccgggttaccctttagtactcggtaacgaaccgaaaacctaagccgtaagttactaaaccgtggaaaccgtttacgggtacggg

SEQ ID NO: 345372 - DNA, 676 bp, Homo sapiens
  misc_feature: GZ8MTXP02HR74X.3.85.H08.1.454.CMB.2.raw
  modified_base (398)..(398): a, c, t, g, unknown or other
  misc_feature (398)..(398): n is a, c, g, or t
tcagagacgcactccacgaccggtgctcgatttagtatcactcagtcgcggggagctctgagagaggagcccagccctgggattttcaggttgttttcatttggtgatcaggactgaacagagagaactcaccatggagtttgggctgagctggtctttttcttgtggtcttaattttaaaaggtgtccagtgtgaggtgcagcgtggtggaggtcgtggggggagtcgttggtacagccggtgggggggtccctggacgaccttctcctggtcgcacgcctgtggtacttcctacctttaagtaattatcgacctatgagccgtcgggtcccgcccgaggtccgtaccggaagggggacggggtcgtgggacggtgggtctcgagtctaagttacgngtatcggtaggtgtaaaccactatacgtacgcacgtacctccggaggaaccggggccctcttaccacctacttccacccgaagactaactaaactacgaaacgaactccgattcactatctagacaaaagtcgaaccagtccgagacgaacggcccgtaaggtaaccctacggtttccctttaaattaccggtagacccgtaaacccgaaaaactaacttaacccgaaaactttaacgaaacggttaccggtaaaaacgtttaggggtttaaacgggg

SEQ ID NO: 345373 - DNA, 720 bp, Homo sapiens
  misc_feature: GZ8MTXP02IXQG3.3.85.H08.1.454.CMB.2.raw
tcagagacgcactccacgaccggtgctcgatttagtatcactcagtcgcggggagctctgagagaggagcccagccctgggattttcaggtgttttcatttggtgatcaggactgaacagagagaactcaccatggagtttgggctgagctggtctttttcttgtggtcttaattttaaaggtgtccagtgtgaggtgaagcgtggtggaggtcgtgggggaggtcgttggtacgacggccggttcggggggtccctggacgtaccttcctccgtggtgcacgtcccttcgtggtacttaccttaaccgttttaagttaaattatcgtacctagtcggacgtccggtcggggtccccgaccggacgggtccgtaccgggaagggggaggggtcggtgggtacgggttcgggtctcgagtcttagttagtgtagtcggtggtacgtaacactacgtcgtacgacacgtaccgtccggtaggaaccggggtccctcttaccacctactcccgtaacgaagaactaacctaaacgttaaccaaaaggtaacccacgtactcgactactcgtaacgaactaaaacgcgaacacgccgtaaggacggacgaccggaggtaacccgtaccggtttaccctttagtacgtcgtaccgaaaacctaaactactccgaaacgttaacgtaaacgtacggtaaacggtttacgggtaacgggtttacggg

SEQ ID NO: 345374 - DNA, 546 bp, Homo sapiens
  misc_feature: GZ8MTXP01C8OFL.52.85.H08.1.454.CMB.2.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttgggggaaaatatgcttgctggtatcaacagcggccaggccagtcccctgtactggtcatctatctagaatagtaggcggccctgtgggactccctgaccccgattctctcggcctccccactcgtagggaaaccacacgccactctcgaccatccgaggccgggacccaggctttgggatggaggctgacttattacgtgtcgaggcgtgggacaccgatacacgtggaagtaagtagttcgggcggagggaccgagggccgtcggacccgttcgttagggtcacggcccgaacggccttccgtccccgttcggtccc

SEQ ID NO: 345375 - DNA, 618 bp, Homo sapiens
  misc_feature: GZ8MTXP01B6KEL.52.85.H08.1.454.CMB.2.raw
  modified_base (517)..(517): a, c, t, g, unknown or other
  misc_feature (517)..(517): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctgagataaagttgggggaaatatgcttgctggtatcaacagccggcaggccacgtcccctgtactggtcatctatctagaatagtacggccggcctcgtcgggactccccgtgaccccgtattcgtcgtcggcctcccactcgtgggaacacacgcccactctacgaccatccgacggccgggacccagggtaccgtttgggacttggacgggctaggacttagttacgtgtacgacggcgtagggaccaccgatacgacgtggagttaagttacggttaacgggcgggacggggtaacccncggggtactcgggttaaccccggttccgttaaacgggtcccgtaccggaaccccggtaaacgggtcccgttaccggtcccccccgttcgggttaacccccg

SEQ ID NO: 345376 - DNA, 592 bp, Homo sapiens
  misc_feature: GZ8MTXP01AC05Q.52.85.H08.1.454.CMB.2.raw
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccacatcactgctctgagataagttagggggaaatntgcttgctggtatacaacgagcggccagccacgtcccctgtactggtcatctatctagtaataggtacggccggtccctcgtgggtactcccgtagacccctagttcncgtcggtccctacccactcgtagggaaaccacgacgacccacgtactacgacccatccgaacgggccgggtaccaggtccgtttggaacgtggacggtctaggtacttatacggtgtccgagggtccgtaggaccaccgagtcctagtcggtaatattcgggtcgggcgggttacggaccgaggtccgttacggcccgtttcgacggtcacggccccgaaggcccgttaccgtcccccgttcggtcccc

SEQ ID NO: 345377 - DNA, 511 bp, Homo sapiens
  misc_feature: GZ8MTXP02HGD8R.52.85.H08.1.454.CMB.2.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccacatcacctgctctggagataaagttgggggaaaatatgcttgctggtatcaacagcggccaggccagtcccctgtactggtcatctatctgaatagtaggcggcctcgtgggactccctgaccccgtattctctggctcccactctgggaacacagccactctgaccatcagcgggacccaggcttggatgagctgactattactgtcaggcgtaggacacgatcacgtggaataataagttcgggacggacgggaccaggctcgaccgtcgtaggtcagccccgaaggcctacggcccccttcggccc

SEQ ID NO: 345378 - DNA, 683 bp, Homo sapiens
  misc_feature: GZ8MTXP02IHWW5.52.85.H08.1.454.CMB.2.raw
tcagcgcagtacgacacgaccggtgctcgatttagtatcactcagtcgcggggctgggcctcaggaagcagcatcggaggtgcctcagccatggcatggatccctctcttccctcggcgtccttgcttactgcacaggatccgtggcctcctatgacctgactcagccaccctcagtgtccgtgtctccaggacagacagccaccatcacctgctctggagataaagttgggggaaaatatgcttgctggtatcaacagcgccaggccacgtcccctgtactggtcatctatctagaataggtacggccggcctcgtggggactcccgtacgaccccgtattcctcgtcggcctccccactccgtagggaaacaccgacgcccactctcgaccatccgacggccggacccaggtccgtttaggatcggacggtactaggtaaccttacgtttacgtggtaccgacgggtacggttacgggaaccaccgtaacttcccgtaacgttaggtaaacgttaaacgttaacgggtttccgggggaacggggtaaaccggggaacccgtacgggggaccttaccggggaaaccccggtttaccgtaacgggggttaacccgaaccgggaacccccggtaaacgggtccccgttaccccgggtcccccccggtttaacgggttacccccg

SEQ ID NO: 345379 - DNA, 641 bp, Homo sapiens
  misc_feature: GZ8MTXP02JQE0A.52.85.H08.1.454.CMB.2.raw
  modified_base (221)..(221): a, c, t, g, unknown or other
  misc_feature (221)..(221): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagcccaccctcagtgtccgtgtctccaggacagacagccaccatcacctgctctgganataaagttagggggaaatatgcttgctggtatcaaacagcggccaggccagtccccctgtactggtcatctatctagaataggtacggccggtccctcgtgggtactcccgtgaccccgattcctcgtcggcctcccactccgtagggaacaccagccactctcgaccatccgagccgggacccaggtctttacggattcggaaggctacggtaactatttacgtcggtacgacgggtcgtagggaacctacccgattcccgaaagtgggtaaacgttaaacgttacggttaccgggggacgggaacgggggaaccccgttagggaccgtaccggtaaaccccggttccggttaaaccggcgaacccgggtacccgttaacggggcctaccccggtccccccggtcgggtttaacccccg

SEQ ID NO: 345380 - DNA, 533 bp, Homo sapiens
  misc_feature: GZ8MTXP02GS4BA.52.85.H08.1.454.CMB.2.raw
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttgggggaaaatatgcttgctggtatcaacagcggccaggccagtccccctgtacctggtcatctatctgaatagtaggcggccctgtgggatcccgtgaccccgtattctctggcctcccactctagggaacacgacgccactctcgaccatcagccgggacccaggtcttggatcgaggctgactatactgcagggcgtaggacaccgtatcacgtggagtaaatcgtacgggacgggtagggaccgaggccgtagaacccgtcgtagggtcacgcccgaacgctaccggtccccgtcggtcccg

SEQ ID NO: 345381 - DNA, 716 bp, Homo sapiens
  misc_feature: GZ8MTXP02HS83U.52.85.H08.1.454.CMB.2.raw
  modified_base (540)..(540): a, c, t, g, unknown or other
  misc_feature (540)..(540): n is a, c, g, or t
tcagcgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagcccaccctcagtcgtccgtgtctccgaggacagacacgccaccatcacctgctcgtggagaagttaaaggttaggggggaaaattagttagctttggcgttaggtactaccgaaacgacggccggaccacggacccgtaccgtccccgtagtacgtcggtctacttctattaccgttagaaagttacggtacgggtcccggtcccgttcggtacggggtacctccccgtacggtaccccgttacttcccgttcgtccgggtaccttcccccgtaacgttccggtaacgggaaaccacgaccgtacccctacgtacttaccgacctaacgtacccggaggacccggggaacccttggggttaccttaggggtaacncggggtaacgtcgtaacgttactttacgtttagtacggttacgggacggtacgggtaccgaaccaccgtatacgacgtaggtaagtaattacgggtcggacgggtacgacgtaggtcgtaccggaccgttccggtgaaccgacggtacccgacggtcctccccgcgttaccggtcc

SEQ ID NO: 345382 - DNA, 520 bp, Homo sapiens
  misc_feature: GZ8MTXP01EHZOX.8.10.A10.1.454.CMB.2.raw
  modified_base (361)..(361): a, c, t, g, unknown or other
  misc_feature (361)..(361): n is a, c, g, or t
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaaggggaaagagcccaccctctcctgcagggccagtcttagtgttagcaacttagcctggtaaccaacagaaacctggccaggctcccaggctctcatctctgatacatccaacagggccatggcactcccagccaggttcagtgcaggtgggtctgggacagacttcactcncaaccatcagcagcctagacgctagaagtatttgctactttatactgtcagcagtcgtagtaacgtggtcctttcacgtttcggccctgggaaccaaagtgtaatatacaaagaactgttgcttgcacnttcttgtctcnctcctccgctaattctaag

SEQ ID NO: 345383 - DNA, 533 bp, Homo sapiens
  misc_feature: GZ8MTXP01D99SK.8.10.A10.1.454.CMB.2.raw
  modified_base (281)..(281): a, c, t, g, unknown or other
  misc_feature (281)..(281): n is a, c, g, or t
  modified_base (524)..(524): a, c, t, g, unknown or other
  misc_feature (524)..(524): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaagagccaccctctcctgcagggccagtcttagtgttagcaaacttgcctggtaccaacagaaacctggccaggctcccaggctccncatctctgatacatccaacagggccactggcatcccagccaggttcagtgcaggtggtctgggacagacttcactctcaaccatcagcagcctagagcctgaatatttgctactttattacttgtcagcagtcgtaagtaacgttcggtcctttctacgtttccggcccgtgggacctaaaaggtggtaatatacaaacgaactgttggtcttgcaccattcttgtcttcaacttccttcccnctcttcgtg

SEQ ID NO: 345384 - DNA, 517 bp, Homo sapiens
  misc_feature: GZ8MTXP01EWA0Y.8.10.A10.1.454.CMB.2.raw
  modified_base (206)..(206): a, c, t, g, unknown or other
  misc_feature (206)..(206): n is a, c, g, or t
  modified_base (473)..(473): a, c, t, g, unknown or other
  misc_feature (473)..(473): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctntcctgcagggccagtcttagtgttagcaacttagcctggtaccaacagaaacctggccaggctcccaggctcctcatctctgatacatccaacagggccactggcatcccagccaggttcagtgcagtggtctgggacagacttcactctcaaccatcagcagcctagacgctagaagtattttgctactttatacttgtcagcagcgtagtaactggtcctttcactttcggccctgggaacctaaagtgaatatcaaagaactgnggcttgcacattcttgtcttcaacttcttcccgctaattctaag

SEQ ID NO: 345385 - DNA, 531 bp, Homo sapiens
  misc_feature: GZ8MTXP01EJY5H.8.10.A10.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (495)..(495): a, c, t, g, unknown or other
  misc_feature (495)..(495): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagcaacttagcctggtaccaacagaaacctggccaggctccaggctccncatctctgatacatccaanagggccactggcatcccagccaggttcaggtggcaggtgggtctgggacagacttcactctcnccatccagcagcctagacgcctgaagtattttgactacttttattactgtcagcagtcgtagttaacgtggtcctttcactttcggcccttgggaccaaagtgtatatcaaagaactgttaggcttgcctacnttcttcgttcttcaattccttcccgctaacgttctg

SEQ ID NO: 345386 - DNA, 511 bp, Homo sapiens
  misc_feature: GZ8MTXP01EYMMN.8.10.A10.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (433)..(433): a, c, t, g, unknown or other
  misc_feature (433)..(433): n is a, c, g, or t
  modified_base (480)..(480): a, c, t, g, unknown or other
  misc_feature (480)..(480): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctntcctgcagggccagtcttagtgttagcaacttagcctggtaccaanagaaacctggccaggctcccaggctcctcatctctgatacatccaacngggccactggcatccccagccagggttcaggtgcaggtgggtctggggacagacttcactctcnccatcagcagcctagacgcctgaagtatttgctacttttatactgtcagcagcgtagtacgtgtcctttnacgttcgcctgggacaagtcgatatacaaacgaatgttgcttgcacnttcttgtctctctcctccgctaacttcgaag

SEQ ID NO: 345387 - DNA, 524 bp, Homo sapiens
  misc_feature: GZ8MTXP01D62U7.8.10.A10.1.454.CMB.2.raw
  modified_base (195)..(195): a, c, t, g, unknown or other
  misc_feature (195)..(195): n is a, c, g, or t
  modified_base (277)..(277): a, c, t, g, unknown or other
  misc_feature (277)..(277): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (511)..(511): a, c, t, g, unknown or other
  misc_feature (511)..(511): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctccaggggaaanagccacctctcctgcagggccagtcttagtgttagcaacttagcctggtaccaacagaaacctggccaggctcccaggctcncatctctgatacatccaacagggccactggcatcccagccaggttcagtgcagtgggtctgggacagacttcactcncnccatcaagcagcctagacgcctagaagtatttcgctacttttatactgtcagcagcgtagtacgtggtcctttcactttcgccctgggaccaaagtgatatacaaacgtaactgttggcttggactaccattcttgtcttcaattccgttccccnctaacgttcgtcg

SEQ ID NO: 345388 - DNA, 562 bp, Homo sapiens
  misc_feature: GZ8MTXP01C0Q0P.8.10.A10.1.454.CMB.2.raw
  modified_base (280)..(280): a, c, t, g, unknown or other
  misc_feature (280)..(280): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctccncatctctgatacatccaacagggccactggcatcccagccaggttcagtggcaggtggtctgggacagcttcactctcaaccatcagcagcctagacgctgaagtatttgctactttattactgtcagcagtcgtaagtaacgttcgggtcccttttacaccgttttccgggccccttagggggaaccctaaaaggtcggtaaattaactacgaaaacggtaactggttgggcttgacaccattcttagtctttcaacttccttcccgctaagttcctaagg

SEQ ID NO: 345389 - DNA, 525 bp, Homo sapiens
  misc_feature: GZ8MTXP01BR4SL.8.10.A10.1.454.CMB.2.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (477)..(477): a, c, t, g, unknown or other
  misc_feature (477)..(477): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctccaggggaaagagccaccctctcctgcagggccagtcttagtgttagcaacttagcctggtaccaacagaaacctggccaggcctcccaggctccnatctctgatacatccaanagggccactggcatcccagccaggttcagtgcagtgggtctgggacagcttcactctcncatcagcagcctagngctgagtatttgctactttattactgtcagcagacgtagtaacgtggtccttttttcacgtttccggcccgtcgggactaaacgtggtatatacaaacgaactgnggcttgcacattcttgtcttctaactccttcccgcctaacttcgtaag

SEQ ID NO: 345390 - DNA, 520 bp, Homo sapiens
  misc_feature: GZ8MTXP01EB4Y4.8.10.A10.1.454.CMB.2.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctntcctgcagggccagtcttagtgttagctaacttagcctaggtaaccaanagaaacctggaccaggctcccaggctccnatctctgatacatccaanagggccactggcactcccagccaggttcaggtggcagtggtctgggacagacttcactctcaaccatcagcagcctagancctgaagtntttgactacttttattactgtcagcagacgtagtaacgtggtcctttcactttcggcctgggaccaaagtgtatatacaaacgaactgttagcttgcacnttcttntctnaatctccnctaattcaag

SEQ ID NO: 345391 - DNA, 531 bp, Homo sapiens
  misc_feature: GZ8MTXP01DB338.8.10.A10.1.454.CMB.2.raw
  modified_base (195)..(195): a, c, t, g, unknown or other
  misc_feature (195)..(195): n is a, c, g, or t
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (496)..(496): a, c, t, g, unknown or other
  misc_feature (496)..(496): n is a, c, g, or t
  modified_base (519)..(519): a, c, t, g, unknown or other
  misc_feature (519)..(519): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctcgaggggaaanagccaccctctcctgcagggccagtcttagtgttagcaacttagcctggtaccaacagaaacctggccaggctcccaggctccncatctctgatacatccaacngggccactggcactcccagccaggttcagtggcaggtggtctgggacagacttcactcncaacatcagcagcctagacgctagaagtattttgcttactttattactgtcagcagcgtaagtaacgtcggtcctttcacgtttccggccctagggaaccaaaggtgtaatatacaaacgaacgtgttggcttgcacnttcttgtctctaactcccttccnctaacgttcaag

SEQ ID NO: 345392 - DNA, 588 bp, Homo sapiens
  misc_feature: GZ8MTXP01A6MUW.8.10.A10.1.454.CMB.2.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (387)..(387): a, c, t, g, unknown or other
  misc_feature (387)..(387): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaangccaccctctcctgcagggccagtcttagtgttagcaacttagcctggtaccaacagaaacctggccaggctcccaggctccncatctctgatacatccaacngggccactggcatcccagccaggttcagtggcagtgggtctgggacagacttcactctcaaccatcagcagcctagacgcctagaagtntttgcttactttatactgtcagcagtacgtaagtacgtcggtcctttcgtaccgtttccggccccgttaggggaaccctaaagggttggtaacttaacgtaccgaaaacggtaacgtggttacgggccttaggaccaacccttagttccttcggttcctttcctaactttccccttccccgaccttaacgttcccgtaagg

SEQ ID NO: 345393 - DNA, 565 bp, Homo sapiens
  misc_feature: GZ8MTXP01DSHE0.8.10.A10.1.454.CMB.2.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagcaacttagcctggtaccaacagaaacctggccaggctcccaggctccncatctctgatacatccaacagggccactggcatcccagccaggttcagtggcaggtggtctcggggacagacttcactctcaaccatcagcagcctagacncctagaagtntttgctattttatactgtcagcagtcgtaagtaacgtcggtcctttcgtactttccggccctagggaacctaaaggtcggtaatactacaaaacgtaactggttacggcttcggacctaaccagttcttagttccttcaactttcccttccccggactaacttccgtaacggg

SEQ ID NO: 345394 - DNA, 552 bp, Homo sapiens
  misc_feature: GZ8MTXP01ENAHG.8.10.A10.1.454.CMB.2.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
  modified_base (365)..(365): a, c, t, g, unknown or other
  misc_feature (365)..(365): n is a, c, g, or t
  modified_base (524)..(524): a, c, t, g, unknown or other
  misc_feature (524)..(524): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagcaacttagcctggtaccaacagaaacctggccaggctccaggctcncatctctgatacatccaacagggccactggcactcccagccaggttcaggtgcaggtgggtctgggacagactcactctcaaccgntcagcagcctagacgcctagaagtattttgactattttatactgtcagcagcgtaagttaacgtcggtcctttacaccgtttcggcccgttgggaacctaaaggtcggtaatactacgaaacgtaactggttacggcttgactaccagttcttgtcttnaacttccttcccgactaacttcgtaacg

SEQ ID NO: 345395 - DNA, 511 bp, Homo sapiens
  misc_feature: GZ8MTXP01BV7SM.8.10.A10.1.454.CMB.2.raw
  modified_base (196)..(196): a, c, t, g, unknown or other
  misc_feature (196)..(196): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatcccagccaggttcagtgcagtggtctgggacagacttcactctcnccatcagcagcctagngcctgaagtatttgctactttatactgtcagcagcgtagtacgtggtcctttcactttcggccctgggaccaaagtggaatatcaaacgaactgttggcttgcacattcttgtctcaactcttccgctaattctaag

SEQ ID NO: 345396 - DNA, 548 bp, Homo sapiens
  misc_feature: GZ8MTXP01CTDN1.8.10.A10.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (359)..(359): a, c, t, g, unknown or other
  misc_feature (359)..(359): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagcaacttagcctggtaccaacagaaacctggccaggctcccaggctcncatctctgatacatccaangggccactggcatcccagccaggttcagtggcaggtggtctgggacagtctcactctacnccatccagcacgcctagacgcctagaagtatttgactactttattactgtacagaagtcgtagttaactggggtccctttgtacctttcgggcccttagggacctaaaggtggatatacaaacgtctggtcggctgcctaccgtattccgttgttccttgacttccgttccgtcttatccgttgaaccg

SEQ ID NO: 345397 - DNA, 521 bp, Homo sapiens
  misc_feature: GZ8MTXP01BU55A.8.10.A10.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaangccaccctntcctgcagggccagtcttagtgttagcaacttagcctggtaccaacagaaacctggccaggctccaggctcncatctctgatacatccaacngggccactggcatccccagcctaggttcaggtggcaggtgggtctggggacagactcactctcncntcagcagcctagacncctgaagtatttgctactttatactgtcagcagtcgtagtacgtgtcttcacgttcgccgtggaccaagtcgtatactacaacgtaatggttgcttgcacttattcttcgttcttctaacttccttcccgctaacttcgtaacg

SEQ ID NO: 345398 - DNA, 568 bp, Homo sapiens
  misc_feature: GZ8MTXP01EWIUL.8.10.A10.1.454.CMB.2.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (548)..(548): a, c, t, g, unknown or other
  misc_feature (548)..(548): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagctaacttagcctggtaccaanagaaacctggccaggctcccaggctccnatctctgatacatccaacngggccatggcatcccagccaggttcagtgcaggtgggtctggggacagacttcactctcaaccatcagcaagcctagacgcctgaagtatttgctatttatactgtcagcagcgtagtaacgtcggtcctttcacgtttcggccccttaggggaaccctaaaggttggaattaataccgaaaacgtaacttggttagggtcttaggaaccctaattcccgttgttccctttcacttcccgtttccccncttacttccgttaagaaccg

SEQ ID NO: 345399 - DNA, 527 bp, Homo sapiens
  misc_feature: GZ8MTXP01AM8L8.8.10.A10.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (362)..(362): a, c, t, g, unknown or other
  misc_feature (362)..(362): n is a, c, g, or t
  modified_base (492)..(492): a, c, t, g, unknown or other
  misc_feature (492)..(492): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctccncatctctgatacatccaacagggcccactggcatccccagccaggttcagtggcagtgggtctgggacagacttcactctcnccatcagcagcctagacgcctagaagtatttgctactttattactgtcagcagcgtagtaacgtggtcctttctacgtttccggcccgtgggaaccaaggtgtatatacaaagaactgttgcttgcacgnttcttgtcttctcttcttcccgctaagttcgtaag

SEQ ID NO: 345400 - DNA, 521 bp, Homo sapiens
  misc_feature: GZ8MTXP01BGE8A.8.10.A10.1.454.CMB.2.raw
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctccncatctctgatacatccaacngggccactggcatcccagccaggttcagtggcagtggtctgggacagacttcactctcnccatcagcagcctagacgcctgaagtatttgctactttatactgtcagtcagcgtagtaactggtcctttcactttcggccctgggacccaaagtggtatagtacaaagaactgttaggcttgcacattcttgtcttcaatccttcccgcctaagttctaag

SEQ ID NO: 345401 - DNA, 564 bp, Homo sapiens
  misc_feature: GZ8MTXP01DT9PX.8.10.A10.1.454.CMB.2.raw
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaagagccaccctctcctgcagggccagtcttagtgttagcaacttagcctggtaccaacagaaacctggccaggctcccaggctcctcatctctgatacatccaacacgggccactggcatcccagccaggtttcagtggcaggtggtctgggacagacttcactcncncatcagcagcctagacgcctagaagtatttgcttactttattactgtcagcagtacgttaagttaacgttcggtcccttttacgtaccgttttccgggccccgttagggaaccctaaaaggtggtaatacgtacaaacgtaactggttggacttgactaccttagttcttgttcttctcttcctcccgctaacttcgtaag

SEQ ID NO: 345402 - DNA, 630 bp, Homo sapiens
  misc_feature: GZ8MTXP01DECOC.8.10.A10.1.454.CMB.2.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
  modified_base (407)..(407): a, c, t, g, unknown or other
  misc_feature (407)..(407): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgagggaaanacgccaccctctcctgcagggccagtcttagtgttagcaacttacgcctaggtaacccaaacacgaaaaccctcgggacccaggcctcccgaggtcctcctcatcctctagactacactaccaacgaggccactggaccactcccagcctaggttcaggtggctaggtggtctcgggacagtctcactcctacnccatcagcagcctagcnctagaacgttatttgacttatttattactgtacagtctaggtacgttaacgttaaccggttcggttaccctttaccgtaccgtttccgggaccccgttaggggaaaccctaaaaggttcgtaaattacgtaacgtaaaacgaacgtttcggaggtccttgaccctaaccttattcgttacgttcttactaaccgtttccctccccgttactaacttcgtaacg

SEQ ID NO: 345403 - DNA, 554 bp, Homo sapiens
  misc_feature: GZ8MTXP01BIYU1.8.10.A10.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagcccaccctctcctgcagggccagtcttagtgttagcaacttagcctggtaccaacagaaacctggccaggctcccaggctccncatctctgatacatccaacgngggccactggcatcccagccaggttcaggtggcaggtggtctggggacagtacttcactcncnccatcagccagcctagacgcctagaagtntttcgctaactttattactgtcagcagacgttagtaacgtcggtacctttcgacgtttccggccccttaggggaccctaaaggtcggattaacgacaaaacgaactgttggacttcgcaccacttcttcgtcttctaactcctccttccaacgttcgtcg

SEQ ID NO: 345404 - DNA, 601 bp, Homo sapiens
  misc_feature: GZ8MTXP01AP3RG.8.10.A10.1.454.CMB.2.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (356)..(356): a, c, t, g, unknown or other
  misc_feature (356)..(356): n is a, c, g, or t
  modified_base (377)..(377): a, c, t, g, unknown or other
  misc_feature (377)..(377): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctcgaggggaaanacgcccaccctctcctgcagggccagtcttagtgttagctaacttagcctggtaacccaanagaaacctggccaggctcccaggctccncatctctgatacactaccaacacgggccacgtggcactccccagcctaggttcaggtggcaggtgggtcnggggacagtacttcactaccncaaccatcagccaagccgtaagacgcctagaaagttatttgacttattttattactgtactagctaagtacgttaagttaacggttcggttaccctttcgtaccgtttccggcccgtagggaaccctaaaggtggtaactaacgtacaaacgtaacgtgttcggacttgaccaacttacttcgttcgtaacttcaacttcctcccgttactaacgttcgtaacg

SEQ ID NO: 345405 - DNA, 595 bp, Homo sapiens
  misc_feature: GZ8MTXP01C85UH.8.10.A10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccacggagaaattgtgttgacacagtctccagccaccctgtctttgcctccgaggggaaanacgccaccctctcctgcagggccagtcttagtgttagcaacttagcctaggtaaccaacagaaacctggaccaggctcccaggctccncatctctagatacactaccaacgacgggccacgtggaccactccccagcctagggtttcaggtggacaggtggtctagggacagtctcactctacaaccatcagcagcctagcgctagaattatttcgacttactttatactgtacagcaggtacgtacgtaacgtcggttacctttcacgtttccggaccgttagggactaaaggtgtaattacacaaaacgggtaactggttaggtcttcggacctaaccgttagtttccttaacgttccttacaacctttcccggttcccaccttaattcccgtaagg

SEQ ID NO: 345406 - DNA, 533 bp, Homo sapiens
  misc_feature: GZ8MTXP01BWDIS.8.10.A10.1.454.CMB.2.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (500)..(500): a, c, t, g, unknown or other
  misc_feature (500)..(500): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagcaacttagcctggtaaccaanagaaacctggccaggctcccaggctcncatctctgatacatccaacagggccactggcatcccagccagggttcaggtggcaggtgggtctggggacagacttcactctcaaccatcagcagcctagacgtcctagaagtattttgctaacttttattactgtcagcagtcgtagtaacgtcggtcctttcacgtttcggccctgggacctaaagtcgtatatacaaacgaatgttgcttagcacnttcttgtctcaactcctcccgctaattcgtaag

SEQ ID NO: 345407 - DNA, 520 bp, Homo sapiens
  misc_feature: GZ8MTXP01EJTKS.8.10.A10.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctntcctgcagggccagtcttagtgttagcaacttagcctggtaccaacagaaacctggccaggctcccaggctcctcatctctgatacatccaacagggccactggcatcccagccaggttcagtggcaggtgggtctcggggacagacttcactctcnccatcagcagcctangcctgagtatttgactactttatactgtcagcagcgtagtaacgtcggtcctttctcgtttcggcccttgggaccaaagtggtatatacgaaacgaactgttaggcttgcaccnttcttgtctcntcctccgctnttcgtcg

SEQ ID NO: 345408 - DNA, 596 bp, Homo sapiens
  misc_feature: GZ8MTXP01E28TJ.8.10.A10.1.454.CMB.2.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
  modified_base (377)..(377): a, c, t, g, unknown or other
  misc_feature (377)..(377): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccgaaggggaaangcccaccctctcctgcagggccagtcttagtgttagctaacttagcctaggtaaccaacagaaacctggccaggctccaggctccnatctctagatacataccaaacgacgggcccactggccactccccagccaggttcaggtgcaggtggtctgggacagtactcactctacaacntcagcagcctagacgctagaagtatttgacttatttactacgtgtacagcagtacgttacgtaacggtcggttacccttttccgaccgtttccggccccgttagggaacctaaaggtggtaataactacgaaacgtaacgtggttcggcttcggaccctaacacttccgttcgttaaccttctaaccttccccttccccgacctaacgttcccgtaagg

SEQ ID NO: 345409 - DNA, 534 bp, Homo sapiens
  misc_feature: GZ8MTXP01EVTFT.8.10.A10.1.454.CMB.2.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
  modified_base (487)..(487): a, c, t, g, unknown or other
  misc_feature (487)..(487): n is a, c, g, or t
  modified_base (512)..(512): a, c, t, g, unknown or other
  misc_feature (512)..(512): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccgaaggggaaangcccaccctctcctgcagggccagtcttagtgttagctaacttagcctaggtaaccaacagaaacctggaccaggcctccaggctcncatctcngatacatccaacagggccactggcactcccagccaggttcagtgcagtgggtctgggacagacttcactctcaaccntcagcagcctagcgctagaatatttgctatttatactgtcagcagtcgtagtaacgtggtcctttcacgtttcggcccgtgggaacctaaaggtcgtaatatacgaaacgaactggnggcttcgctaccagttcttgttctnaacttcctcccgctaattcaag

SEQ ID NO: 345410 - DNA, 856 bp, Homo sapiens
  misc_feature: GZ8MTXP01ADAE7.8.10.A10.1.454.CMB.2.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctcaggggaaangccaccctctcctgcagggccagtcttagtgttagcaacttagcctggtaaccaacagaaacctggccaggctcccgaggctccncatctctgatacataccaacgacgggcccactcgggacacgttccccgaggcccctaagggtttccaagggttcgggaccgtaaggggttcgggggtaccgttagggggaacctacgggtaacccttttacccgaaccgtttcccttacccaacccccgtaattacccgaaacgggtacccgaaacgggtaccccgttaaagggaacccggtacccgttaaggtaaaaccgggtttatttttacggaacctttaaacgttttttaaactttaacgttacggtttaccaaaggtaccgtaacgggttaacggtttaacggtttaaaaccgggtttcggggtttaaccccttttttacccgttaacccggtttttacccggggtaccccgtttaacgggggaaaccccgtttaaaaaggggttcgggtaaaacgtttaaacctaacgtaaaaccggttaaaccgttagggttacggggtccttacgggaccgtaacccgttaacgtttccgtttacgtttccctttaccgtaaccttttccccggttccccgttaccgttaacgtttccgtaaccggg

SEQ ID NO: 345411 - DNA, 520 bp, Homo sapiens
  misc_feature: GZ8MTXP01AGVOJ.8.10.A10.1.454.CMB.2.raw
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (385)..(385): a, c, t, g, unknown or other
  misc_feature (385)..(385): n is a, c, g, or t
  modified_base (511)..(511): a, c, t, g, unknown or other
  misc_feature (511)..(511): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctccncatctctgatacataccaanagggccactggcatcccagccaggttcagtgcagtggtctggacagacttcactctcnccatcagcagcctagacgctagaagtntttgactactttatactgtcagcagctagtaacgtggcctttcactttcggccctgggaccaaagtgtatagtacaaacgaatgttggcttgacacttattcttgtcttcaattccttccgacctnttccgtaag

SEQ ID NO: 345412 - DNA, 515 bp, Homo sapiens
  misc_feature: GZ8MTXP01BPWJB.8.10.A10.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcagggccagtcttagtgttagcaacttagcctggtaccacagaaacctggccaggctcccgaggctccncatctctgatacataccaacagggcccacgtggcatcccagccaggttcagtgcaggtggtctggggacagcttcactctcaaccatcagcagcctagacgcctgaagtntttgctatttatactgtcagcagcgtagtacgtggtcctttcaccgtttcggccctgggaccaaagtggtatatcaaagtaactggttgcttgccncnttcngtctcnctctcccgctaagttctg

SEQ ID NO: 345413 - DNA, 550 bp, Homo sapiens
  misc_feature: GZ8MTXP01A3CBQ.8.10.A10.1.454.CMB.2.raw
  modified_base (280)..(280): a, c, t, g, unknown or other
  misc_feature (280)..(280): n is a, c, g, or t
  modified_base (361)..(361): a, c, t, g, unknown or other
  misc_feature (361)..(361): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctccncatctctgatacatccaacagggccactggcatcccagccaggttcagtgcaggtgggtctggggacagacttcactctcnccatccagcagcctagacgcctgaagtattttgctaatttatactgtcagtcagcgtagtaacgttggtccctttcaccgtttccggccccgtggggaacccaaagtcggtaatataccaaacgtaaactgttggcttgccaaccttagttcttgttcttcaacttccttccccgctaacttcgtaacg

SEQ ID NO: 345414 - DNA, 588 bp, Homo sapiens
  misc_feature: GZ8MTXP01AGF84.8.10.A10.1.454.CMB.2.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (418)..(418): a, c, t, g, unknown or other
  misc_feature (418)..(418): n is a, c, g, or t
  modified_base (577)..(577): a, c, t, g, unknown or other
  misc_feature (577)..(577): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctccaggggaaanacgccaccctctcctgcagggccagtcttagtgttagcaacttagcctggtaccaacagaaacctggccaggcctccagctcncatctctnatacatccaanagggcccacgtggacatccccagccctaggtttccaggttggactagtttcggggtctcggggacaggtacctttcaactctaccaacccatcgaagcacgtcctagacgcctagaagttntttgacttatttatctagtcagtcagacgttagtaacgtcggtacctttcgaccgtttccggccgtagggtaaccgtaaaggtcggtaatacgtaacgaaacgtaactggcgtccttgccctacattcgttacttccttactaacttccgttcccactnttcccgtaagg

SEQ ID NO: 345415 - DNA, 563 bp, Homo sapiens
  misc_feature: GZ8MTXP01C3EHC.8.10.A10.1.454.CMB.2.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (369)..(369): a, c, t, g, unknown or other
  misc_feature (369)..(369): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgagggaaanagccaccctctcctgcagggccagtcttagtgttagcaacttagcctggtaaccaacagaaacctggccaggctcccaggctccncatctctgatacatccaacgagggccactggccactccccagccagggtttcaggtggcaggtggtctcgggacagacttcactctcnccatcagcagcctagacgcctagaacgtatttgacttactttattacttgtaccagcagtacgttaagttaacgttcggtcctttctaccgtttccggcccgtagggacctaaaggtgtaatatacaaacgaactgttggcttgacctcttagttcttagtcttctaacttccttcccgctaacgttcgtaacg

SEQ ID NO: 345416 - DNA, 800 bp, Homo sapiens
  misc_feature: GZ8MTXP01AMYZB.8.10.A10.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaangcccaccctctcctgcagggccagtcttagtgttagctaacttagcctaggtaaccaacagaaacctggccaggctcccaggcctcncatctctgatacatacccaacgacggggcccaacgtgggacctactcccccgaaggtccccgtaaggggtttcccaagggttcgggaccgtaagggggtttcggggggttacctacggggggaacctagggtacccttttaccgaaccttcccttaccaaccctatacccgaaggccccacggtaccccgtaagggaccggtacccgttaaggtaaacggttactttttacggacctttaactttttaactttaaccgttcggttaccgaacggtaccgtaaggttaccggttaaacggttaaccggttacggggtttcccctttttaccggtaaccccggttttcccgggaccccggtttacggggaaaccccgttaaaagggttcggtaaacttaaacgtaaccgtaaaaccgggtaaaccgttgggttaacgggtccttcgggtaccctaaccgttacgttccgttacgttccttcctaacgttcccttccccggactaacgttccgtaacgg

SEQ ID NO: 345417 - DNA, 529 bp, Homo sapiens
  misc_feature: GZ8MTXP01AUEUP.8.10.A10.1.454.CMB.2.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (371)..(371): a, c, t, g, unknown or other
  misc_feature (371)..(371): n is a, c, g, or t
  modified_base (483)..(483): a, c, t, g, unknown or other
  misc_feature (483)..(483): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctcgaggggaangccaccctntcctgcagggccagtcttagtgttagctaacttagcctggtaaccaacagaaacctggaccaggcctcccaggctcctcatctctgatacatccaacgagggccactggcactccccagccaggtttcaggtggcaggtgggtctgggacagacttcactctcaaccntcagcagcctagacgcctagatatttcgacttatttatactgtcagcagcgtagtacgtggtcctttcgacgtttccggcctcggacctaagtgtatactacaaagaactgngcttgcacattcttgtcttcaacttccttccgctaacgttcgtaag

SEQ ID NO: 345418 - DNA, 835 bp, Homo sapiens
  misc_feature: GZ8MTXP01BTT1D.8.10.A10.1.454.CMB.2.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (285)..(285): a, c, t, g, unknown or other
  misc_feature (285)..(285): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccgaaggggaaancgcccaccctctcctgcagggccagtcttagtgttagctaacttgcctggtaacccaanagaaacctggccaggcctccgagctcncatctctagactacactaccaacgcgggcccacgtggaccactccccgagcccgtaagggtttcagggttcggactaggggttcggggtacctgggggaacctaggtaccctttccaccgttccctacaaccctagtcccgagcctaacggcccttaagggaccgtacccgttaaggtaaacgtttacgtttttacggaaccttttaacgtttttaaactttaaccgttacggttaccgtaacggtaccgtaacgggttaccggtttaaacgggtttaaacccggggtttccggggttttaccccttttttacccgttaccccgggttttttacccggggacccccgggtttaacgggggtaaaaccccgttaaaaaccggggttgggtaaacctttaaacggtaaacccggtaaaaccggttaaacggttcgggttaacgggtcccttacggaacccgttaacccgttacgtttcccgtttaccggtttaaccctttaccgtaaccgtttaccccttcccccgggttaccttaacgttccgtaaccggg

SEQ ID NO: 345419 - DNA, 724 bp, Homo sapiens
  misc_feature: GZ8MTXP01C6ZKN.8.10.A10.1.454.CMB.2.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctccagataccacggagaaattgtgttgacacagtctccagccaccctgtctttgcctccgaggggaaanacgccaccctctcctgcagggccagtcttagtgttagcaacttagcctaggtaaccaacagaaacctggccaggctcccaggctccncatctctgatacatccaacgagggccacgtggccactccccagccaggtttccaggttggcctaggtcgggtcgtggggactagtacttcgactcctcaactatcagcactcctagacgcctagaactattttgacttactttaactttaacgtcgttacgaacgtcgtacggtacggttaaacgttaaacgggtttcggggtttccccttttaccgttaacccggtttttcccggggaccccgtttaaacgggggtaaaccccgttaaaagggtttcgggtaaaactttaacgtaaacccggtaaaaaccgggttaaaaccgttgggtttaaaccgggctttaacgggaccctaaacccggttaacgttccctttacggtttaaccctttaccgtaacgttttccccgtccccgttaccctaacttccccgttaaacggg

SEQ ID NO: 345420 - DNA, 676 bp, Homo sapiens
  misc_feature: GZ8MTXP01ELDYQ.8.10.A10.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaanagccaccctntcctgcagggccagtcttagtgttagcaacttagcctggtacccaanagaaacctggccaggcctcccaggctccncatctctgatacatccaacagggccactgcatcccagccaggttcagtggcagtgggtctcggggacagacttcactctcnccatcaagcacgcctagacgcctagaactagttttgactaactttttacttaaccttggttacacggtactaacggtacggttaacgttaaaccggttcgggttaccccttttaccgtaaccgttttaccgggcccccggtttaacgggggaacccctaaaaggggtttcggaaactttaaaccgttaaccgaaaaacggtaaacccgtttaggttccgggactttaccggaccctaccttaacttccgggttacgttaaccctttccgtaactttccccgtttaccccggaccgttaaccttcccgttaacgg

SEQ ID NO: 345421 - DNA, 555 bp, Homo sapiens
  misc_feature: GZ8MTXP01A124P.8.10.A10.1.454.CMB.2.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaaccaacagaaacctggccaggctccaggctcnatctcngatacatccaacgngggccagtggcactccccagccaggtttcaggtggacaggtgggtctggggacaggacttcacctctcaaccntcgagcagcctaagacnctagagtntttgcttagtttatactntcagcagtacgtaagtacgttcgggtcctttcgacgtttccggccgtaggaacctaaggtgtatacgtacaaagtaactggttcgacttgacctaccagttcttagtcttcaacttccttacccgctaacttccgtaag

SEQ ID NO: 345422 - DNA, 653 bp, Homo sapiens
  misc_feature: GZ8MTXP01CCWH7.8.10.A10.1.454.CMB.2.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccaggggaaangcccaccctctccngcagggccagtcttagtgttagcaacttagcctggtaccaacagaaacctggccaggcctcccgaggctcctcatctctgactacactccaacgacggggcccacgtggccactccccgagcctagggtttcaggtggcaggtcgggtctcggggacaggtaccttcactctaccaaccatccagcacgcctagacgccgtagtaagttatttcgaccttacttttacttacgttgtacgagtctaacggtacgttaacgttaaccggttcgggttaccctttccgtacccgtttccgggccccgttacgggtaacccgtaaaggtcggtaatacgtaaccgaaacggtaacgtcggttacgggtcttcggaccctaccgttacgttccttaccggttccttaccctaacgtttccccttcccgacctaacttcgtaaccgg

SEQ ID NO: 345423 - DNA, 750 bp, Homo sapiens
  misc_feature: GZ8MTXP01DN4LK.8.10.A10.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggcctcccagataccaccggagaaattgtgttgacacagtctccagccaccctgtcttgcctccgagggaaancgccaccctctcctgcagggccagttcttagtgttagctaacttgcctggtaaccaanagaaacctggaccaggctcccgaggcctctcatctctgactacactaccaacgacgggcccacgtcggacctaacgtcccaagtcccgtagggtttcagggttcggacctaggggttcggggtcctagggggacctaacggttacctttcccgaaccttccctaccaaccgtacttccgacgtaccaaccgtccgtaaaggtccgtacccgttagtaaacggtttacttttacgaccctttaattttaagtttcctacgggttacacgggtaccctaaggttaccggttaaacggttaaccggtttcggtttaccccgttttaccgtacccgttttccgggaccccgttaggtaaacccgtaaaggtggtaaacttaacgtaacgaaacggtaacttgggttaccggtcttaggacccctaacgttcttccgtttcggttaacccttaacggtccctttcccgggttacccccttacgttaacgttccgtaacgg

SEQ ID NO: 345424 - DNA, 759 bp, Homo sapiens
  misc_feature: GZ8MTXP01A89VV.8.10.A10.1.454.CMB.2.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggaccagagggaaccatggaagcccagctcagcttctcttcctcctgctactctggctcccagataccaccggagaaattgtgttgacacagtctccagccaccctgtctttgcctaccgaggggaaancgcccaccctctcctgcagggccagtcttagtgttagctaacttagcctaggtaccaacagaaacctggccaggcctcccgaggcctcctcatctctgactacactccaacgcgggcccacgtggccactccccgagtcctagggtttcaggtggccagggtcggggtctacggggacctagtacccttcgacccttcctaccaaccctagttacccgaacgggtcctaacggtacccggttaaaggtacccggtacccgttaaggttaaacgttagtttttacggtacctttaacgtttttaactttaaccgttcggttaccaaggtacctaacgggttaccggttaaacggttaaaccgggttccggggtttaccccttttacccgttaacccgtttttccggggaccccgttacggggtaaacccgtaaaacggttcgggtaaacttaacgtaaacccgtaaacggtaacgttcgggttacgtaccgttcgaccgtaaccttcgtttccttacgttccttacctaaccttcccgtccccgttactaacgtttcgtaacgg

SEQ ID NO: 345425 - DNA, 679 bp, Homo sapiens
  misc_feature: GZ8MTXP01B04TO.8.10.A10.1.454.CMB.2.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaancgcccaccctctcctgcagggccagttcttagtgttagctaacgttgcctggtaaccaacgagaaacctggccaggcctcccgaggcctccncactctctgataccatacccaacgacgggccctacgtggccacgtccccgagtcccagggtttcaggttcggcgtaggttcggggtcgtacgggggacctaggtaccttaccaccttccgtaccaacctatcccgaacggccaacgtacccgtaaggaccgtcccgttaggtaagtttacttttcgacttaacttttaacgttacttgtacgagtcgaacggtacgttaacgttaacggttcggtttaccctttaccgtaccggtttcccggtacccgtacgggaacccgtaaaggtcgtataacgtaacgaaacgtaacgtggttacgcttacgaccgtacttagttcttcgtccttcgtccgtttccctcccgacttcgttcgtaacg

SEQ ID NO: 345426 - DNA, 630 bp, Homo sapiens
  misc_feature: GZ8MTXP01BVYGH.8.10.A10.1.454.CMB.2.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccgaggggaaangccaccctctcctgcagggccagtcttagtgttagctaacttagcctggtaaccaacagaaacctggccaggctcccgaggctccnactctcngataccataccaacgacgggccacgtggccactccccagccaggtttcaggtggctaggtgggtctcgggacagtctcactctcaaccntccagcagcctagacncctagtaagttattgacttactttaactttactgtcacgcgtaggtacggttaacgttaacggtcggtttcccgtttaccgtacgttttacccgggccccgttaggggtaacccgtaaaggtcgggtaaacttaacggttacaaaaccggttaacgtcggttacggtcttacggtcctaacgttacgttcttcggtccctttctaacttccccttcccgactaacttcgtaacg

SEQ ID NO: 345427 - DNA, 801 bp, Homo sapiens
  misc_feature: GZ8MTXP01DEQMZ.8.10.A10.1.454.CMB.2.raw
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttcgcctccgaaggggaanacgcccaccctctcctgcgacgggcctagtcttagtgttagctaacttagcctaggtaccaacacgaaacctcggaccaggcctcccgaggcctccncatctactagatacactaccaacgacgggccacgtcggaccactaccccgaggtccgtacgggtttcgaagggttcggacgtacggggtcggggtacggttacggggactacggtacctttaccgaaccctttcccaccaacccgtatcccgaaggaccgtacgaccggtaagaccgtaccgttagggtaaactttacgttttcgtaaccttttaactttttaacgttacgttcgttaacgtacgtacgtaacgtaacgggtttaacgttaaccgggtttccggttacccttttaaccgttacccgggttttacccggggacccggttaaggggtaaacccgttaaacggggttacggtaaacgttaaacgtaaaccgtaaaccgggttaaacgttcgggttaccgggtacgttacccgaccttaaccgttacgtttccgttacgtttccctttacgtaaccctttccccggtacccgttacccgttaacgttccggtaaccggg

SEQ ID NO: 345428 - DNA, 711 bp, Homo sapiens
  misc_feature: GZ8MTXP01EM9M7.8.10.A10.1.454.CMB.2.raw
  modified_base (199)..(199): a, c, t, g, unknown or other
  misc_feature (199)..(199): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccgaaggggaaanagccaccctctcctgcagggccagtcttagtgttagctaacttagcctggtaaccaaacagaaacctggaccaggctcccgaggctcctcatctctgaatacataccaacgagggcccaactggaccaacgtccccgagtcccgtaagggtttcaaggttggaccagggttcgggggtacctagggggaaccaaggtaacctttccaaccgtccttaccaacccgaatcccgaaagccaaggccctaaaggacgtaccctagtaaagtaattttgactaacttttaacttactgtacaggacaagtacgttagtaaacgtcggtaccttttacgaaccgtttcgggaccccgttagggtaaacccgaaaaaggttcgggaaattaacgtaaaccaaaaaacgggtaaacctttcgggttaaggggccgttacgtaccaaacccgttaagtttccttaacgttccttacccgtaactttccccgtttccccgacctaactttccgtaaacggg

SEQ ID NO: 345429 - DNA, 899 bp, Homo sapiens
  misc_feature: GZ8MTXP01A46GX.8.10.A10.1.454.CMB.2.raw
  modified_base (201)..(201): a, c, t, g, unknown or other
  misc_feature (201)..(201): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagcccaccctgtctttcgcctccgaaggggaaancgcccaccctctcctgcgagggccagtcttagtgttagactaacttagcctaggtaaccaacaacgaaacctggaccaggcctcccgaggtcctcctcattcctctacgactaccaactaccgaacgacggggaccccacggtcggacctacgtaccccgacgtacccgtagggtttcagggtcggacgtaggggttcgggggttcgtaccgggggaacctacgggttacccttacctaaccttcccgtacccaacccgtactacccggaacggaccctaacgggtacccttaaagggtacccggtacccgtttaagggtaaaacgttttacgtttttaccggaaccttttaaacttttttacgtttaaaccgtttcggttaaccgtaacggttaccgttaaacggggttaccggtttaaaccgggtttaacccgggtttccggggttttaacccctttttacccgtaaaccccgggttttttccccgggggaaccccggttaaacgggggttaaacccgtaaaagggggtttcgtaaacgtttaaaccgtaaacccggttaaaaacgggtaaccggtttgggttacgggtaccttaccggtaacccgtaacccttacggtttcccttccggtttaacctttccctaacccggtttcccccttaccccgggttaccttaaccgtttcgggtaacccgg

SEQ ID NO: 345430 - DNA, 584 bp, Homo sapiens
  misc_feature: GZ8MTXP01A6FAN.8.10.A10.1.454.CMB.2.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
tcagctcgcgtgtccacgaccggtgctcgatttagcgtcgatctcaggggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctntcctgcagggccagtcttagtgttagcaacttagcctggtaaccaacagaaacctggccaggctccaggctccnatctntgatacatccaanagggccatggcatcccagccagggtttcaggtggcaggtgggtctagggacaggtacttccactcctacnccatcagcagcctagacgctagaagtatttgactatttaattactgtcagcaagtacgtaacgttaacgtcggtacctttcaaccgtttccggcccgtggggaaacccgtaaagtcgggtaattaactacaaaacggtaactggttaggaccttgaccacccttaagttccttacgttccttctaacttccttcccgcctaactttcgtaacgg

SEQ ID NO: 345431 - DNA, 523 bp, Homo sapiens
  misc_feature: GZ8MTXP02G4EQ4.8.10.A10.1.454.CMB.2.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagctcgcgtgtccacgaccggtgctcgatttagcgtcgatctcaggggaggaactgctcagttaggacccagagggaaccatggaagccccagctcagcttctcttcctcctgctactctggctcccagataccaccggagaaattgtgttgacacagtctccagccaccctgtctttgcctccaggggaanagccacctctcctgcagggccagtcttagtgttagcaacttagcctggtaccaacagaaacctggccaggctcccaggctcctcatctctgatacatccaacagggccactggcatccccagccaggttcagtggcagtgggtctggggacagacttcactctcnccatcagcagccctagagcctgaagtatttgactactttattactgtcagcagcgtagtaactggtccttctacgtttccgcccgttgggaaccaaggtggatactacgaaacgtaactgtagctgactaccatctgtcttctacttcctcccgccactctacg

SEQ ID NO: 345432 - DNA, 516 bp, Homo sapiens
  misc_feature: GZ8MTXP02GPT46.8.10.A10.1.454.CMB.2.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (377)..(377): a, c, t, g, unknown or other
  misc_feature (377)..(377): n is a, c, g, or t
tcagctcgcgtgtccacgaccggtgctcgatttagcgtcgatctcaggggaggaactgctcagttaggacccagagggaactatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaanagaaacctggccaggctcccaggcctcctcatctctgatacatccaacagggccactggcatcccagccaggttcagtggcagtggtctgggacagacttcactctcaccatcagcagcctagacncctgaagtatttgctactttatactgtcagcagcgtagtactggtcctttcactttcggcctagggacctaagtggatatacaaaacgtacgtgtggctgcaccgatctagtcttcacttccttcccgctacttctacg

SEQ ID NO: 345433 - DNA, 498 bp, Homo sapiens
  misc_feature: GZ8MTXP02FX910.8.10.A10.1.454.CMB.2.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
  modified_base (357)..(357): a, c, t, g, unknown or other
  misc_feature (357)..(357): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaangggccactggcatcccagccaggttcagtgcagtggtctgggacagacttcactctcnccatcagccagcctagacgcctgaagtattttgctactttatactgtcagcagcgtagtactgtctttcactttcgcctggaccaagtgatatcaaacgtactgtgctgcacgatctgtctcacttctcccgctactctag

SEQ ID NO: 345434 - DNA, 766 bp, Homo sapiens
  misc_feature: GZ8MTXP02HGIXU.8.10.A10.1.454.CMB.2.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaanagccaccctctcctgcagggccagtcttagtgttagcaacttagcctggtaccaanagaaacctggccaggcctcccgaggctcctcatctctgactacactacccaaacgacgggcccacgtggaccactccccgagccctagggtttccaggttcggaccgtaggggtcggggtcgtacggggaccacggtacctttccgaccttccttaccaccctaattccaacggcctacgcccttaaggacgtacccgttaggaaacggttacttttacggacctttaactttttacttttaacgtcgttaccgtaacgtaccgtaaggttaccggttaaggtttaaaccgttcggggtttaccccttttaccgttaacccggtttttcccgggacccccgtttagggggaaaccccgttaaaagggttaccgggtaattaacgttaaccgaaaaaccggttaaccgttaggggttcggtaccgtacggaccctaaccccgttaatttccgttacggttccctttaccgtaaccgtttcccctttcccccggtacccttaacttcccgtaacggg

SEQ ID NO: 345435 - DNA, 515 bp, Homo sapiens
  misc_feature: GZ8MTXP02FVJ05.8.10.A10.1.454.CMB.2.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatcccagccaggttcagtgcagtgggtctgggacagacttcactctcaccatcagccagcctagagcctgaagtatttgctactttatactgtcagtcagtcgtagtaactggtcctttcacgtttcgcccgtgggaccaagtcgatactacaaaacgactgtgctgcacatctagtcttcattccttcccgactactctacgg

SEQ ID NO: 345436 - DNA, 521 bp, Homo sapiens
  misc_feature: GZ8MTXP02GHKOI.8.10.A10.1.454.CMB.2.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcagggccagtcttagtgttagcaacttagcctggtaccaacagaaacctggccaggctcccaggctctcatctctgatacatccaanaggccactggcatcccagccaggttcagtggcaggtggtctgggacagacttcactctcaccatcagcagcctagagcctgaagtatttgctactttatactgtcagcagcgtagtaactggtcctttcgacgtttccggacccgttggggaaccaaaagttggaatagtacaaaacgaactgtaggctagcaccatctagtcttcactcttcccgctatctag

SEQ ID NO: 345437 - DNA, 518 bp, Homo sapiens
  misc_feature: GZ8MTXP02FM32M.8.10.A10.1.454.CMB.2.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagacgcctagaagtattttgctactttatactgtcagcagcgtagtaactggtcctttcactttcggcccgtaggaccaaaggtgaatatacaaaacgactgtaggctgacactatctgtcttcactcttcccgctactctacgg

SEQ ID NO: 345438 - DNA, 533 bp, Homo sapiens
  misc_feature: GZ8MTXP02F9O94.8.10.A10.1.454.CMB.2.raw
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaanagggccactggcatccccagccaggttcagtggcaggtgggtctggggacagacttcactctcnccatcagcagccctagacgcctgaaagtnttttgctactttatactgtcagcagacgtagtaactggtcctttcacctttcggcccttaggggaccaaaaggtcggaatatacaaacgtaactgtggctgcaccgatctagttccttcacttccttcccgctactcctag

SEQ ID NO: 345439 - DNA, 522 bp, Homo sapiens
  misc_feature: GZ8MTXP02I3X6F.8.10.A10.1.454.CMB.2.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaanagccaccctctcctgcagggccagtcttagtgttagcaacttagcctggtaccaacagaaacctggccaggctcccaggctcctcatctctgatacatcccaagacgggccacgtggcactccccagccctagggttcagtggcaggtgggtctggggacagacttcactctcaccatcagcagcctagacgcctagaagtattttgcttactttattactgtcagcagcgtagtaactggtcctttcacgtttcgccctgggacctaagtggatatacaaaacgtactgtggctgacacatctgtctcactcctccgctatctag

SEQ ID NO: 345440 - DNA, 506 bp, Homo sapiens
  misc_feature: GZ8MTXP02GL4ZE.8.10.A10.1.454.CMB.2.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaanagggccactggcatcccagccaggttcagtgcagtgggtctgggacagacttcactctcaccatcagcagcctagacgcctagaagtatttgctactttatactgtcagcagcgtagtactggtcctttcacgtttcgccctggaccaagtgatatacaaacgtactgtggctgcaccatctgtcttcactctcccgctactctacg

SEQ ID NO: 345441 - DNA, 507 bp, Homo sapiens
  misc_feature: GZ8MTXP02FTC0C.8.10.A10.1.454.CMB.2.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaanagaaacctggccaggctcccaggctcctcatctctgatacatccaacagggccactggcatcccagccaggttcagtgcagtggtctgggacagacttcactcncncatcagcagcctagacgcctgaagtattttgctactttatactgtcagtcagcgtagtaactggtcctttcactttcgcccgtggacaagtgatatacaaacgactgtagctgacaccatctagtcttcactccttcccgctactctag

SEQ ID NO: 345442 - DNA, 515 bp, Homo sapiens
  misc_feature: GZ8MTXP02FXDJX.8.10.A10.1.454.CMB.2.raw
  modified_base (196)..(196): a, c, t, g, unknown or other
  misc_feature (196)..(196): n is a, c, g, or t
  modified_base (358)..(358): a, c, t, g, unknown or other
  misc_feature (358)..(358): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttgcctggtaccaacagaaacctggccaggctcccaggctcctcatctctgatacatccaacagggccactggcatcccagccaggttcagtggcagtggtctgggacagacttcactctcnccatcagcagcctagacgcctagaagtatttgctactttatactgtcagcagcgtagtaactcggtcctttctacgtttcgcccgtagggacctaaggtcgatatacgaaacgtactgtagctgacaccatctgtctctactctcccgctactctag

SEQ ID NO: 345443 - DNA, 511 bp, Homo sapiens
  misc_feature: GZ8MTXP02IYJSP.8.10.A10.1.454.CMB.2.raw
  modified_base (195)..(195): a, c, t, g, unknown or other
  misc_feature (195)..(195): n is a, c, g, or t
  modified_base (356)..(356): a, c, t, g, unknown or other
  misc_feature (356)..(356): n is a, c, g, or t
  modified_base (358)..(358): a, c, t, g, unknown or other
  misc_feature (358)..(358): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaanagccaccctctcctgcagggccagtcttagtgttagcaacttagcctggtaccaacagaaacctggccaggctcccaggctcctcatctctgatacatccaacagggccactggcatcccagccaggttcagtggcagtggtctgggacagacttcactcncncatcagcagctagagcctgagtatttgctactttatactgtcagcagcgtagtactggtcctttcacgtttcggcccttgggacctaaaggtggatactacaaacgtaactgtaggctgacactatctgtcttcactcctcccgctactctag

SEQ ID NO: 345444 - DNA, 511 bp, Homo sapiens
  misc_feature: GZ8MTXP02GZWH3.8.10.A10.1.454.CMB.2.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagctcgcgtgtccacgaccggtgctcgatttagcgtcgatctcaggggaggaactgctcagttaggacccagagggaaccatggaagccccagctcagcttctcttcctcctgctactctggctccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaanaggccactggcatccagccaggttcagtgcagtgggtctggggacagtacttcactctcnccatcagcagcctaagacgcctagaagtatttgactactttatactgtcagacagacgtagtaactcggtacttcactttcggccctgggacctaagtcgatatacaaacgactgtgctgacacatctagtctcactcttcccgctactctacg

SEQ ID NO: 345445 - DNA, 539 bp, Homo sapiens
  misc_feature: GZ8MTXP02H8WRU.8.10.A10.1.454.CMB.2.raw
  modified_base (195)..(195): a, c, t, g, unknown or other
  misc_feature (195)..(195): n is a, c, g, or t
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (507)..(507): a, c, t, g, unknown or other
  misc_feature (507)..(507): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaangccaccctctcctgcagggccagtcttagtgttagcaacttagcctggtaccaanagaaacctggccaggctcccaggctcctnatctctgatacatcccaanacgggccactggccatcccagccaggttcagtggcaggtggtctgggacagtacttcactctcaccntcagcagcctagcncctgaagtatttgactacttttatactgtcagtcagtcgtagtaactggtcctttcacgtttccggcccttagggaacctaaggtggatagtacgaaaacgtactgtacggctcgactaccattcgtnttccttcacttcccttcccgcctattcctagg

SEQ ID NO: 345446 - DNA, 536 bp, Homo sapiens
  misc_feature: GZ8MTXP02FXEDQ.8.10.A10.1.454.CMB.2.raw
  modified_base (196)..(196): a, c, t, g, unknown or other
  misc_feature (196)..(196): n is a, c, g, or t
  modified_base (364)..(364): a, c, t, g, unknown or other
  misc_feature (364)..(364): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggcctcccaggctcctcatctctgatacatccaacagggccactggcatcccagccaggttcaggtgcaggtggtctgggacagacttcactctcaccntcagcagcctagcgcctagaagtatttgactatttatactgtcagcagacgtagtactcggtcctttctacgtttcgcccgtagggaacctaagtcggatacgtacgaaaacgtactggtaggctacgactacctactctagtccttactacttccttcccgctactctacg

SEQ ID NO: 345447 - DNA, 618 bp, Homo sapiens
  misc_feature: GZ8MTXP02GO9P5.8.10.A10.1.454.CMB.2.raw
  modified_base (197)..(197): a, c, t, g, unknown or other
  misc_feature (197)..(197): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagcaacttgcctggtaaccaacagaaacctggccaggctcccaggcctcctcatctctgatacataccaacgagggccaacgtggcactccccgagccaggttcaggtggcaggtgggtctggggacagacttcactctacaccatcagcagacctagcgcctagaaagttattttgacttaacttttatacgttgtacagactaggtacgttaagtaaacgttcggttaccctttcgtaaccgtttcccgggaccccgttaggggaaaccctaaaggtacggtaactaaacgtacgaaaaacgtaacgttggtaggtacctaggacctaacctaacgttcctacgttccttacacgtttccccttcccgacctacgtttcctacgg

SEQ ID NO: 345448 - DNA, 533 bp, Homo sapiens
  misc_feature: GZ8MTXP02I147Q.8.10.A10.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (226)..(226): a, c, t, g, unknown or other
  misc_feature (226)..(226): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaanagccaccctntcctgcagggccagttttagngttagcaacttagcctggtaccaacagaaacctggccaggctcccaggctcctcatctctgatacatccaacagggccactggcactccccagccaggttcagtggcagtggtctgggaccagcttcactctcaccntcagcagcctagacncctagagtattttgctactttattactgttcagcagcttagtaactggtcctttnaccgtttcggacctgggaaccaaagtggaatatacaaacgtaactggtacgctcggcactacttctgtcttaacacttccttcccgctacttcctgaacg

SEQ ID NO: 345449 - DNA, 620 bp, Homo sapiens
  misc_feature: GZ8MTXP02IN08P.8.10.A10.1.454.CMB.2.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccacctgtctttgcctcgaggggaangccacctntcctgcagggccagttcttagtgttagcaacttagcctggtaaccaacagaaaccctggcccaaggcctcccgaggcctcctcatcctctagaatacaataccaaacgacgggccacgtggacactccccagccctaggtttccaggtcgcgtaggtcgggtcgtcggggacaggtacttcactcctacacctatccaagccaacgccctaaggacgacccgttagaaagttagtttttacgacttaactttttacttaactgtacaagtcaagtacgtaagttaactcggttcttaccgtaccgtttcggacccgtaggaaacctaaaggtggtaatacgtaacgaaaacgtacgtgtcggactggacctaacctcttcgtcttaactctacttccctaccgtacctacgttcgtacg

SEQ ID NO: 345450 - DNA, 558 bp, Homo sapiens
  misc_feature: GZ8MTXP02GIVRK.8.10.A10.1.454.CMB.2.raw
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagcccaccctctcctgcagggccagtcttagtgttagcaacttgcctggtaccaacagaaacctggccaggctcccaggcctcctcatctctgatacatccaacagggccactggcactccccagccagggttcaggtggcaggtgggtctggggacagacttcactctcaccatcagcagcctagacgcctagaaagtattttgactaacttttattactgtcagtacagtacgttaagtaacgttcggtcctttcgtaccgtttccggacccgttagggaacctaaaggtggaatagtacgaaaacgtaacgtggtaggctgacaccactctgtcttcacttccttcccgactactctag

SEQ ID NO: 345451 - DNA, 578 bp, Homo sapiens
  misc_feature: GZ8MTXP02GW0WN.8.10.A10.1.454.CMB.2.raw
  modified_base (363)..(363): a, c, t, g, unknown or other
  misc_feature (363)..(363): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccagggttcagtggcaggtgggtctggggacagacttcactctcnccatcagcagcctagacgcctgaaagtattttgctattttattactgtcagcagtacgtagttaacgtggttcctttctaccgtttccggcccgtacggggtaacctaaaggtggaattacgtacgaaaacgtaccgtggtacggcttacggacctaacctacttcttacgttaacctttacacctttccctaccccgtcctacttccgtaacgg

SEQ ID NO: 345452 - DNA, 493 bp, Homo sapiens
  misc_feature: GZ8MTXP02JFQZ4.8.10.A10.1.454.CMB.2.raw
  modified_base (196)..(196): a, c, t, g, unknown or other
  misc_feature (196)..(196): n is a, c, g, or t
  modified_base (358)..(358): a, c, t, g, unknown or other
  misc_feature (358)..(358): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcaggaccagtcttagtgttagcaacttagcctggtaccaacagaaacctggccaggctcccaggctcctcatctctgatacatccaacaggccactggcatcccagccaggttcagtggcaggtggtctgggacagacttcactctcnccatcagcagcctagacgctgaagtatttgctatttatactgtcagcagcgtagtactggtcttcactttcgcctggaccaagtgatatacaacgactgtgctgacacatctgtctcactctccgctactctacg

SEQ ID NO: 345453 - DNA, 517 bp, Homo sapiens
  misc_feature: GZ8MTXP02IX7NV.8.10.A10.1.454.CMB.2.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (495)..(495): a, c, t, g, unknown or other
  misc_feature (495)..(495): n is a, c, g, or t
  modified_base (509)..(509): a, c, t, g, unknown or other
  misc_feature (509)..(509): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccaccctgtctttgcctccgaggggaaanagccaccctctcctgcagggccagtcttagtgttagcaacttagcctggtaccaanagaaacctggccaggctcccaggctcctnatctctgatacatacccaaanagggccaactggcatccccagcccagggttcagtgcagtgggtctggggacagacttcactcncacatcaagcagcctaagagtacctgaaagtattttagctaactttattactgtcagcagcgtagtaactggtacctttcactttcgccctaggaccaaagtgatagtacaaagactgtagctgcacatntgtctcatcctccnccatcacg

SEQ ID NO: 345454 - DNA, 532 bp, Homo sapiens
  misc_feature: GZ8MTXP02F0KBA.8.10.A10.1.454.CMB.2.raw
  modified_base (196)..(196): a, c, t, g, unknown or other
  misc_feature (196)..(196): n is a, c, g, or t
  modified_base (339)..(339): a, c, t, g, unknown or other
  misc_feature (339)..(339): n is a, c, g, or t
  modified_base (503)..(503): a, c, t, g, unknown or other
  misc_feature (503)..(503): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttgcctggtaccaacagaaacctggccaggctcccaggctcctcatctctgatacatccaacaggccactggcatccagccaggtcagtgcagtggctggacngacttcactctcaccatcagcagcctagacgctagaagtatttgactactttatactgtcagtcagtacgtagtaactcggccttttcgacgtttcggccctaggggaacctaaaggttggatagtacaaaacgtaactggtaggctcgacaacctatcctttntcttactacttcctacccgactactctag

SEQ ID NO: 345455 - DNA, 553 bp, Homo sapiens
  misc_feature: GZ8MTXP02ICS81.8.10.A10.1.454.CMB.2.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctcgaggggaaanagccaccctctcctgcagggccagtcttagtgttagcaacttgcctggtaccaanagaaacctggccaggctcccgaggcctcctcatctctgatacatccaancgggccagtggcatccccagcctaggtcagtgcaggtggtcngggacagtcttcacttcncaccatcagcagcctagcgctagaagtatttgacttacttttattactgtacagcagtcgttagtaactcggttcctttcgtacgtttccggccgtaggggtaacctaaaggtgtaatacgtacgaaaacgtacgtggtcggacttcggactaccgtattcctagtccttcacttccttcccgctactctacg

SEQ ID NO: 345456 - DNA, 514 bp, Homo sapiens
  misc_feature: GZ8MTXP02GACEX.8.10.A10.1.454.CMB.2.raw
  modified_base (280)..(280): a, c, t, g, unknown or other
  misc_feature (280)..(280): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
  modified_base (506)..(506): a, c, t, g, unknown or other
  misc_feature (506)..(506): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaagagccaccctctcctgcagggccagtcttagtgttagcaacttagcctggtaccaacagaaacctggcaggctcccaggctccncatctctgatacatccaacaggccactggcatcccagccaggttcaggtgcaggtggtctgggacagacttcactctcaccatcagccagacctagacgcctagaagtatttgactatttatactgtcagcagcgtataactggtcctttcactttccggccctggggacctaaagtggatanacaaaacgactgtgctgacaccatctntcttcactccttcccnctactctg

SEQ ID NO: 345457 - DNA, 527 bp, Homo sapiens
  misc_feature: GZ8MTXP02GGOT7.8.10.A10.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctccgaggggaaanagccacctctcctgcagggccagtcttagtgttagcaacttagcctggtaccaacagaaacctggccaggctcccaggctcctnatctctgatacatccaacagggccactggcaatccccagcccagggttcaggtggcaggtgggtctggggacagacttcactctcaccatcagccagccctagacgcctgaaagtattttagactaattttatactgtcagcagtacgtagtaactggtcctttcacgtttcgcccttgggacctaaagtcgatatacaaaacgactgtaggctgcaccatctagtcttcatcctccgcctatctag

SEQ ID NO: 345458 - DNA, 558 bp, Homo sapiens
  misc_feature: GZ8MTXP02H0GMS.8.10.A10.1.454.CMB.2.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
  modified_base (394)..(394): a, c, t, g, unknown or other
  misc_feature (394)..(394): n is a, c, g, or t
  modified_base (556)..(556): a, c, t, g, unknown or other
  misc_feature (556)..(556): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaattgtgttgacacagtctccagccacctgtctttgcctcaggggaangccaccctntcctgcagggccagtcttagtgttagctaacttagcctggtaaccaanagaaacctggaccaggctcccaggctcctcatctctgatacatccaacagggccactggacatcccagccaggttcagtggcaggtggtctgggacagtacttcactctcacctatcagcaggtccctaagacgcctagaaacgtnttttgacttaactttttatacgtgtacaaggtcagtacgttaagtaacttcgggtacctttctacgtttccgacccgtagggaaccctaaaggtcgaattagtaacgaaaacgtatcgtaggctagacctacatcctgtaacttcactctacccgctattcncg

SEQ ID NO: 345459 - DNA, 534 bp, Homo sapiens
  misc_feature: GZ8MTXP02GAQP6.8.10.A10.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctntcctgcagggccagtcttagtgttagcaacttagcctggtaccaacagaaacctggccaggctcccaggctcctcatctctgatacatccaanagggccactggcatcccagcccaggttcagtggcagtgggtctgggacagacttcactctcnccatcagcagcctagacncctagaagtatttgctactttatactgtcagcagtacgtaagtaactggtcctttcgtacctttccggcccttaggggaaccaaagtggaataagtacaaaacgtaactgtaggctaggacaccatcctgtcttctacttctcccactactctacg

SEQ ID NO: 345460 - DNA, 621 bp, Homo sapiens
  misc_feature: GZ8MTXP02IVYXE.8.10.A10.1.454.CMB.2.raw
  modified_base (193)..(193): a, c, t, g, unknown or other
  misc_feature (193)..(193): n is a, c, g, or t
  modified_base (247)..(247): a, c, t, g, unknown or other
  misc_feature (247)..(247): n is a, c, g, or t
  modified_base (363)..(363): a, c, t, g, unknown or other
  misc_feature (363)..(363): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctcaggggaangccacctctcctgcagggccagtcttagtgttagcaacttagcctggtaccaanagaaacctggccaggctcccaggctctcatctctgatacatccaagaggccactggcactcccagccaggttcagtggctattggggctcggggacagtacttcactcctcacctntcagctacgcctagacgctagaagtatttgcttactttattactagtacagacagtacgtaagtacgttcggttcctttctacgtttcccggacccgttacggggaacctaaaggtacggtaattaacgtaccgaaaacggtaaccgttaggttacgggtaccttacggacccgtaaccgtaacttccgtttcggttaaccctttacctaaccgtttcccccgtttacccccgtacccttaacgttacccttaacggg

SEQ ID NO: 345461 - DNA, 528 bp, Homo sapiens
  misc_feature: GZ8MTXP02JYPO8.8.10.A10.1.454.CMB.2.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggcctcccaggctcctcatctctgatacatccaagngggccactggcatcccagccaggttcagtgctaggtgggtctgggacagcttcactctcaccntcagcagcctagcgcctagaagtatttgactactttatactgtcagtcagtcgtatacgtcgtcttctactttccgccgtagggaacctaagtggtaatacgtacgaaacgtactggcggctggaccacgtctctgtcttcacgttccttcccgcctactctag

SEQ ID NO: 345462 - DNA, 568 bp, Homo sapiens
  misc_feature: GZ8MTXP02IS67W.8.10.A10.1.454.CMB.2.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgactacatacccaacgagggccactggcactcccagccaggttcagtggcaggtggtctgggacagacttcactcncaccntcagcagcctagacncctagaaagttatttgcttactttattactgtcagacagcgtagtaactcggtcctttcgtacgtttcggccctagggaaccctaaaggtgaatactacgaaaacgtacgtggtaggtctcggactacctacgttccttgttccttactacctttcccgttaccccgtcctaacgttcgtaacgg

SEQ ID NO: 345463 - DNA, 515 bp, Homo sapiens
  misc_feature: GZ8MTXP02GMUU3.8.10.A10.1.454.CMB.2.raw
  modified_base (196)..(196): a, c, t, g, unknown or other
  misc_feature (196)..(196): n is a, c, g, or t
  modified_base (362)..(362): a, c, t, g, unknown or other
  misc_feature (362)..(362): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatcccagccaggttcagtggcaggtgggtctggggacagacttcactctcnccatcagcagcctagacgcctagaagtatttgactactttattactgtcagcagtcgtagtaactggtcctttctaccgtttcggccctagggaccaaaggtggatatacaaaacgactgtgctgcacatctgtctcactctcccgctatctg

SEQ ID NO: 345464 - DNA, 642 bp, Homo sapiens
  misc_feature: GZ8MTXP02JTRY0.8.10.A10.1.454.CMB.2.raw
  modified_base (197)..(197): a, c, t, g, unknown or other
  misc_feature (197)..(197): n is a, c, g, or t
  modified_base (254)..(254): a, c, t, g, unknown or other
  misc_feature (254)..(254): n is a, c, g, or t
  modified_base (406)..(406): a, c, t, g, unknown or other
  misc_feature (406)..(406): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagttcttagtgttagcaacttagcctggtaccaanagaaacctggccaggctcccaggctcctcatctctgatacatcccaaacagggccacgtggccactcccagcctagggttcaggtggcaggtcgggtctacggggacagacttcactctcaccatcagcagtcctagacgtcctagaagttntttacgcttaacttttattactgtacaggcagtacgttaacgtaacgttcggttacctttacctacgttttccggaccccgttacggggaacccgtaaagggtacggtaacttaacgttaaccgaaaaaccggttacgtacgggtacggtccgttacgaccgtaaccttacgtacctttggttccctttaccgtaactttccccgtttccccggacccttaagttccgttaacggg

SEQ ID NO: 345465 - DNA, 514 bp, Homo sapiens
  misc_feature: GZ8MTXP02FH6SV.8.10.A10.1.454.CMB.2.raw
  modified_base (196)..(196): a, c, t, g, unknown or other
  misc_feature (196)..(196): n is a, c, g, or t
  modified_base (475)..(475): a, c, t, g, unknown or other
  misc_feature (475)..(475): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatccccagccaggttcagtggcagtggggtctggggacagacttcactctcaccatcagcagcctagacgcctgaaagattttgctacttttatactgtcagcagcgtagaactggcctttcacgtttcgccctggaccaaaggtggatatcaaaacgaactgnggctgcaccatctgtcttctatccttcccgcactctagg

SEQ ID NO: 345466 - DNA, 578 bp, Homo sapiens
  misc_feature: GZ8MTXP02GEODQ.8.10.A10.1.454.CMB.2.raw
  modified_base (195)..(195): a, c, t, g, unknown or other
  misc_feature (195)..(195): n is a, c, g, or t
  modified_base (339)..(339): a, c, t, g, unknown or other
  misc_feature (339)..(339): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaanagccaccctctcctgcagggccagtcttagtgttagcaacttagcctggtaccaacagaaacctggccaggctcccaggctcctcatctctgatacatccaacagggccactggcactcccagccaggttcagtgcagtggtcngggacagcttcactctcaccatcagcagcctagacgcctgaagtatttgtctactttattactgtctagacagacgtagtaacgttacggtcctttcgtaccgtttccggtacccgttacgggtaaccgtaaacggtacggtaagttaacgtacgtaaaacgtaacgtaggtacggtcgtcgactaccgtctaaaaacttcgttaacgttctacttacctttccgtacctactactacg

SEQ ID NO: 345467 - DNA, 730 bp, Homo sapiens
  misc_feature: GZ8MTXP02I30MQ.8.10.A10.1.454.CMB.2.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccaccctgtctttgcctccgaggggaaanagccaccctctcctgcagggccagtcttagtgttagctaacttagccttggtaccaacagaaacctggccaggcctcccaggcctcctcatctctgatacatacccaacgacgggccctaacgtcggaccacgtccccgaaggtccctaagggtttccaaggttcgggaccgtaggggttcggggtcgtacgggggaacctacggtacctttccgaaccttctaccacctaatccgaacggccaacggtccctaaaggacgtccctaggtaaagttacttttacgactttaacttttattaccgtgtacgtacgtacgtacggtacgttaaacgttaaccgttcgggttacccttttacgtacccggttttccggaccccgttagggggaaaccctaaaggttcggaacttaacgtaaccgaaaaccggtacgttacggtacggtacttaacggccctaaacccgtagttccgtttaagttcccgtttaaccgaccgtttccccttacccccggtaccttagtacccgtaacgg

SEQ ID NO: 345468 - DNA, 648 bp, Homo sapiens
  misc_feature: GZ8MTXP02GLTWE.8.10.A10.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctccncatctctgactacactccaacgacgggccacgtggcactccccgaagccctagggttcaggtggctaggtcgggtctggggaccagtacttcactctcactatcagccagccgtaagacgtcctagtaaacgtattttacggacttaagtttttaattaaccttggttaccagtacgtacgtacgttaagtaaaccgttcgggttacccttttaccgtacgttttcccggacccgttacggggtaaacccgtaaaaggttcgggtaataacgtaacgaaaaccgtaacgttggtacgggtctacggacctacctaacttccgtacgtttccttacactttcccttaccccggtactacttcgtaacgg

SEQ ID NO: 345469 - DNA, 514 bp, Homo sapiens
  misc_feature: GZ8MTXP02HFJYX.8.10.A10.1.454.CMB.2.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (504)..(504): a, c, t, g, unknown or other
  misc_feature (504)..(504): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaangccaccctctcctgcagggccagtcttagtgttagcaacttagcctggtaccaacagaaacctggccaggctccaggctcctnatcnctgatacatccaanggccatggcatcccagccaggttcagtggcagtggtcngggacagtacttcactctacnccatcagcaagtcctagacgcctagaacgtatttgacttactttattactgtacagcagcgtataactggtccttcactttcgcctaggactaagtgatatacaagtaactgtagctagacacctatctgtcttacacttcctaccccnctactcgtag

SEQ ID NO: 345470 - DNA, 586 bp, Homo sapiens
  misc_feature: GZ8MTXP02HB0FD.8.10.A10.1.454.CMB.2.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (575)..(575): a, c, t, g, unknown or other
  misc_feature (575)..(575): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccacctgtctttgcctccgaggggaaanagccaccctctcctgcagggccagtcttagtgttagcaacttagcctggtaaccaanagaaacctggccaggctcccagctcctnatctctgatacatacccaaacgagggcccaacgtggcctaactccccaagccaacgggtttcaaggtcggacgaggtcggggtctaggggaacagtacttacactcctacacccaatcaacgcacgtccagacgcctagaaagtattttggacttaacttttattacgtgtacagtacagtaccgtagtaactcggttacctttgacctttcgacccgtgggaaaccaaggtgtaatagtaacaaaaggtactggtagtcacggactaccacttgtctcttacacttccttcccncctaattcacg

SEQ ID NO: 345471 - DNA, 541 bp, Homo sapiens
  misc_feature: GZ8MTXP02FE3JX.8.10.A10.1.454.CMB.2.raw
  modified_base (194)..(194): a, c, t, g, unknown or other
  misc_feature (194)..(194): n is a, c, g, or t
  modified_base (374)..(374): a, c, t, g, unknown or other
  misc_feature (374)..(374): n is a, c, g, or t
tcagctcgcgtgtccacgaccggtgctcgatttagcgtcgatctcagggggaggaactgctcagttaggacccagagggaaccatggaagccccagctcagcttctcctcctcctgctactctggctcccagataccaccggagaaattgtgttgacacagtctcagccacctgtctttgcctccaggggaaangccaccctctcctgcagggccagtcttagtgttagcaaacttagcctggtaccaacagaaaccctggccaggctcccaggctcctcatctctgatacatccaacagggccactggcatccccagccaggtcagtgcagtggtctgggacagacttcactctcaccatcagcagcctagcncctgaagtattttgactactttatactgtacagacagacgtagtaactggtcctttctaccgtttcggccccgtaggggaaccaaaggttcggaatactacgaaaacgtaactggtcgctgacctacctatccgtagtctttacacttccttccgacctactctaag

SEQ ID NO: 345472 - DNA, 718 bp, Homo sapiens
  misc_feature: GZ8MTXP02IXUYH.8.10.A10.1.454.CMB.2.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccacctgtctttgcctccgaggggaaangccaccctctcctgcagggccagttcttagtgttagactaacttagcctaggtaaccaanacgaaacctggccaggcctcccaggcctcctcatctctgatacactaccaacgacgggcccaacgtggcctaacgtccccgaggcccctaagggtttccaagggttcggaccgtaggggttcggggtactcgggggaaccaggtacttccactcctaccacctatccgaacgccacggtaccctaaaggacgtacccgtagtaaaggtttacttttcggacctttaaccttttaattacgtagttaccagtccgaagtacgtaacgttaacgttcggttcctttacgtaccggtttcccggacccgttacggggaaaccctaaaagggtacggtaacttaaacgtaaccgtaaaaccggtaacgttgggtacggtaccgttacggaccctaaccgtacttccgttcgtttaaccttaccgtaaccgtttccccttaaccccgccttaacgtccgttaaacggg

SEQ ID NO: 345473 - DNA, 597 bp, Homo sapiens
  misc_feature: GZ8MTXP02GFPLV.8.10.A10.1.454.CMB.2.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaangccaccctctcctgcagggccagtcttagtgttagctaacttagcctggtaccaacagaaacctggccaggcctcccaggcctcctcatctctgatacatccaacagggccactggcactccccagcctaggtcaggtgcaggtgggtctggggacagacttcactcncaccatcagcacgcctaagacgcctagaagttatttgacttaacttttatacttgtacagacagtacgttaagtaaccgtcgggttcctttactaccggttttccggaccccgttaggggtaaccctaaaggtcggtaactaacgttacgaaaacgtaacgtcggttacggcgttaggacctacctattccgttatcttacctacttcccgttaccctacctactctaacgg

SEQ ID NO: 345474 - DNA, 498 bp, Homo sapiens
  misc_feature: GZ8MTXP02GOM4S.8.10.A10.1.454.CMB.2.raw
  modified_base (196)..(196): a, c, t, g, unknown or other
  misc_feature (196)..(196): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
tcagctcgcgtgtccacgaccggtgctcgatttagcgtcgatctcagggggaggaactgctcagttaggacccagagggaaccacggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacaggccactggcatcccagccaggttcagtgcagtggctgggacngactcactctcacntcagcagcctaganctagagtatttgctactttatactgtcagcagcgtagtactcggctttcacgtttcggccctaggaccaaagtgatatacaaacgtactgtgctgacacatctgtactcactctccgcatctagacg

SEQ ID NO: 345475 - DNA, 507 bp, Homo sapiens
  misc_feature: GZ8MTXP02FTY0U.8.10.A10.1.454.CMB.2.raw
  modified_base (196)..(196): a, c, t, g, unknown or other
  misc_feature (196)..(196): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttagcctggtaccaacagaaacctggccaggctcccaggctcctcatctctgatacatccaacagggccactggcatcccagccaggttcagtgcagtggtcngggacngacttcactctcaccatcagcagcctagacgcctagaatatttagctatttatactgtcagcagcgtatactggtcctttcactttcgcctggaccaagtgatatcaaacgtactggtgctgacactacgtctgtcttacacttccttccgcctactctacg

SEQ ID NO: 345476 - DNA, 544 bp, Homo sapiens
  misc_feature: GZ8MTXP02F4EHI.8.10.A10.1.454.CMB.2.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (277)..(278): a, c, t, g, unknown or other
  misc_feature (277)..(278): n is a, c, g, or t
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (534)..(534): a, c, t, g, unknown or other
  misc_feature (534)..(534): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaangccaccctctcctgcagggccagtcttagtgttagctaacttagtctggtaccaanagaaacctggccaggctccagctcnntcntgatacactccaagaggccatggcactcccagccaggttcaggtcgcaggtcgggtctaggggaccagacttcactctcnccntcagccagcctagncctgaatatttgactatttatactgtacagtacagtacgtagtaactcggttctttacctacgtttccggacccgttaggaacctaaaggtcgtaataactacgaaaacgtacgtgtacggctagcaccactcgtactcttacacttcccgtcccnctactctacg

SEQ ID NO: 345477 - DNA, 559 bp, Homo sapiens
  misc_feature: GZ8MTXP02FJJNO.8.10.A10.1.454.CMB.2.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
tcagctcgcgtgtccacgaccggtgctcgatttagcgtcgatctcagggggaggaactgctcagttaggacccagagggaaccatggaagccccagctcggcttctcttcctcctgctactctggctcccagataccaccggagaaattgtgttgacacagtctccagccaccctgtctttgcctccaggggaaangccaccctctcctgcagggccagtcttagtgttagcaacttagcctggtaaccaacagaaacctggccaggctcccaggctcctcatctctgatacatccaacagggccactggcactccccagcccaggttccaggtggcaggtgggtctggggaccagtactcactctcaccntcagcagcctagacgcctagaacgtattttgcttaactttatttactgttcagcagtcgtaagttaactcggtcctttactacgtttccgggcccgttgggaacccaaaggttggtaactactacgaaaacgaactgtggctgaccacactctgttccttcacttcccttcccgcctactctcgaacg

SEQ ID NO: 345478 - DNA, 641 bp, Homo sapiens
  misc_feature: GZ8MTXP02HUOCL.8.10.A10.1.454.CMB.2.raw
  modified_base (195)..(195): a, c, t, g, unknown or other
  misc_feature (195)..(195): n is a, c, g, or t
  modified_base (594)..(594): a, c, t, g, unknown or other
  misc_feature (594)..(594): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtcttgcctccgaggggaaangccacctctcctgcagggccagttcttagtgttagctaacttgcctaggtaccaacagaaacctggccaggcctccaggctcctcatctctgactacactaccaacgacgggccacgtcggaccaacgtccccaggccctagggtttccaaggttcggacgtaggtggggtctacggggacaggtaccttcacttcctacaccatcagccaagcctagacgctagtaacgtattttcgacttattttacttaccgttgtacgagtcgtaggtacgttaagttaaccgttcgggttaccctttaccgtaaccgtttcccgggacccgttacggggtaaaccctaaaaggtcggtaaattacgtaaccgtaaaaccgtacgttaggtcggactcggtaacnccgtactcgtgttaactacgtacttcctcccgtactactttcgaacg

SEQ ID NO: 345479 - DNA, 721 bp, Homo sapiens
  misc_feature: GZ8MTXP02GY7C7.8.10.A10.1.454.CMB.2.raw
  modified_base (196)..(196): a, c, t, g, unknown or other
  misc_feature (196)..(196): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccacctgtctttgcctccgaggggaaancgccaccctctcctgcagggccagtcttagtgttagctaacttgcctggtaccaacagaaacctggaccaggcctcccgaggctcctcatctctgaactacatacccaaacgacgggacctacgtcggcctacgtccccagccgtaagggtttccaggttcggacctaggggtgggtcctggggacacggtacttcacttcgaccaccgtatcacgcacgaccctaagcgtacctaggtaaacgttatttaggaccttaaactttttagttaaccgttcgttaacgtaacgtcgtaacggtaccggtttaaacggttaaccgttacgggttacccctttttaccgtaacccggtttttcccggggacccccgtttaacggggaaaccccttaaaagggtacggtaaacttaacgtaaaccgtaaaaccggtaaacgtcggttacggacttacggaacctaacctacgttccgttacgttaaccgtttcctacgttacccttcccgtactaccgttaccgtaacgg

SEQ ID NO: 345480 - DNA, 637 bp, Homo sapiens
  misc_feature: GZ8MTXP02IY4W4.8.10.A10.1.454.CMB.2.raw
  modified_base (416)..(416): a, c, t, g, unknown or other
  misc_feature (416)..(416): n is a, c, g, or t
  modified_base (635)..(636): a, c, t, g, unknown or other
  misc_feature (635)..(636): n is a, c, g, or t
tcagctcgcgtgtccacgaccggtgctcgatttagcgtcgatctcaggggacccaaaaaccacacccctccttgggagaatcccctagatcacagctcctcaccatggactggacctggagcattccttttcttggtggcagcagcaacaggtgcccactcccaggttcagctggtgcagtctggagctgagaagttccgagggcaggagtctccatcgaaccatagacacactccgacgaccacagcctatagtggagttgacgagcctgagatcgtagacgacgacggccgtagttacttcgtgtggacggagggtattggtagtaggtggtacggtgggtacgggaccggggtaaacttggaccgtacggcggggaccgaggggtactccccgttggtcctaccgttcctccncgccgcctccgaaccgaccggccctacgttccgtccccttccccgtgaccctacccctccgtaccgaacgccgtccaccgttccgggtcgggaccgacgaccgggccgggtcccgtcgggcctccggcgttacgggaccgtaacgtaccgttacccgttaccgacgtaccggcgtacggcgtacggacggcgggtacgcggcgaacggcgtcgagtcgnng

SEQ ID NO: 345481 - DNA, 790 bp, Homo sapiens
  misc_feature: GZ8MTXP02FOYWN.8.10.A10.1.454.CMB.2.raw
  modified_base (197)..(197): a, c, t, g, unknown or other
  misc_feature (197)..(197): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaangccaccctctcctgcgagggccagtcttagtgttagctaacttagcctaggtaaccaacgacgaaaccgtggaccacggcctcccgaggccctcccgtctacttccttctagtaactacctaactacccaaaccgacggggtaccccacgttcggacctaccgtaccccgacggtaccccgtaagggttaccaaggggttcgggtaccgtaggggttcggggttaccggtacggggaacctaggtaacctttccaacccgtttccctaacccgtacccaactaccggaacgtaccgaaccggtacccgtaaagggaacccgtacccgttaggtaaacgtttacgtttttacgacgtttaaccgtttttaattaccgttcggttacacggtacgtacggtaacggttaacgtaaacgtttcggttacctttaccgttaccgtttcccgggtaccccgtaagggtaaacccgtaaaggttacggtaacttaacgtaaccgtaaaacgtaaccgtggttacggtacgttaccgacctaactacttcgttacgttaacgttacctacgttcccttacccgactaccgtcgtaaccgg

SEQ ID NO: 345482 - DNA, 639 bp, Homo sapiens
  misc_feature: GZ8MTXP02FPQR9.8.10.A10.1.454.CMB.2.raw
  modified_base (197)..(197): a, c, t, g, unknown or other
  misc_feature (197)..(197): n is a, c, g, or t
  modified_base (427)..(427): a, c, t, g, unknown or other
  misc_feature (427)..(427): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanagccaccctctcctgcagggccagtcttagtgttagctaacttagcctaggtaccaacagaaacctggccaggcctcccgaggcctcctcatctctagactacactaccaacgagggcctacgtggccactccccagcctagggttcaggtggacaggtcggggtctacggggactagacttcacctctacaccatcgagtccacggtctaaggacgtcctagtaacgtntttacgcttaattttactacgttgtacagtacgtagtacgttaagtaacgtcgggttacctttcgttaaccgtttccggaccccggttaagggtaaccctaaagggttcggaaacttaacgtaaccgaaaacggtacgttggtacgtacgtacgacctacctacttcgttcgtaaccgttactacttcccgttaccccgatacgtacgtacg

SEQ ID NO: 345483 - DNA, 609 bp, Homo sapiens
  misc_feature: GZ8MTXP02FZP1E.8.10.A10.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (560)..(560): a, c, t, g, unknown or other
  misc_feature (560)..(560): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctcgaggggaaancgccaccctctcctgcagggccagtcttagtgttagctaacttgcctggtaaccaacagaaacctggaccaggctccagctccnatctctganacactaccaacaggccatggcactcccagcctaggttcaggtgactggtgggtctcggganagtactcactctcacntcagcacgactagactacgtagtaaagttactttagacttaaagtttttactaccgttgtaccagtacacgtaaggttaacgttaaacgttccggttacctttaccgtaacccgggtttccggacccccggttaaggaaaccccgttaaaggtacggtaacctagtaaccaaaacgtacgtggttagccgttanacctacacttcgtactcttcctacttccccgtccctactacttcgaacg

SEQ ID NO: 345484 - DNA, 553 bp, Homo sapiens
  misc_feature: GZ8MTXP02FJ19N.8.10.A10.1.454.CMB.2.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
  modified_base (339)..(339): a, c, t, g, unknown or other
  misc_feature (339)..(339): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaanagccaccctctcctgcagggccagtcttagtgttagcaacttgcctggtaccaanagaaacctggccaggctcccaggctcctnatctctgatacatccaacgaggccatggcatcccagccaggttcagtggcaggtggtcnggggacagacttcactctcaccatcagcagcctagacgcctagaagtattttagacttacgtttatacttgtacagccagtcgtagttaacgtcggtacctttctaccgtttccggcccgttagggaacctaaaggtggattaagtacaaaacgtactagtggctgacacctactccgttagtccttacacttccttcccgactacgtctaacg

SEQ ID NO: 345485 - DNA, 649 bp, Homo sapiens
  misc_feature: GZ8MTXP02FHZ36.8.10.A10.1.454.CMB.2.raw
  modified_base (291)..(291): a, c, t, g, unknown or other
  misc_feature (291)..(291): n is a, c, g, or t
  modified_base (392)..(392): a, c, t, g, unknown or other
  misc_feature (392)..(392): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaaggggaaagcgcccaccctctcctgcgagggccagtcttagtgttagctaacttgcctaggtaaccaacacgaaacctggccacggcctcccgaggcctccncatctctgactacactaccaacgacggccacgtcggcactccccgagccgtaggttcaggtcgacgaggtggtcgtaggggacagtactcactccacaccntcagcagtcgtagacgcctagtaagttatttagacttaacttttatacgttcgtacgtagtacgaaggtacgttaaacgtaaacgttcggttacccttttcgtaaccggttttcccgggaccccggtttaacggggaaccttaaaagggtcgaaacttaacgtaaaccgaaaacgtacgttcggtcggacctacgacctacctacgttccgttacgtccgtttacctacgttcccgttcccgactacgtacgtacgg

SEQ ID NO: 345486 - DNA, 661 bp, Homo sapiens
  misc_feature: GZ8MTXP02HTYC2.8.10.A10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctccagataccaccggagaaattgtgttgacacagtctccagccaccctgtctttgcctccgaggggaaanacgccaccctctcctgcagggccagttcttagtgttagctaattgcctggtaaccaacagaaacctggccaggcctcccaggctcctnatctcngactacatccaagngggtccacgtggcactcccagtcccagggtttcaggttcggctagggtcgggtctggggaacngtacttccactcctcncctatccagcctagcctagacgcctagaagttatttcgacttacttttaattctaggtacaggtacctaggtacgtttaaacgttaacgttccgggtttaccttttacccgtaaccggttttcccgggacccgttacgggggtaaaccctaaagggttccggtaaattaaccgtaacgaaaaaccggttcttagggggttacacgttaaacgcctaccgtaacttccttgttaacccttcgtacgtttccccctacccgtacctatttcccggtaacg

SEQ ID NO: 345487 - DNA, 611 bp, Homo sapiens
  misc_feature: GZ8MTXP02I0HZ4.8.10.A10.1.454.CMB.2.raw
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaagagccaccctctcctgcagggccagtcttagtgttagctaacttgcctaggtaacccaacagaaacctggccaggcctcccaggcctcctcatctctgatacatacccaaacgacgggccaacgtggaccaactccccagcctaagggttccaaggtggactaggtggggtctacggggacagtacttcactcctacacctatcagcagacctagacgcctagaaattatttagacttaacttttatactatacgagacagtacgtaagttaaacgtcggttccctttactaccgtttccgacccgttagggaaaccctaaaggtggaacttaagtaccaaaacggtaactggtcggactagacctaccaattcctagttaaccttacacttcctaccccgactacttacgtacg

SEQ ID NO: 345488 - DNA, 566 bp, Homo sapiens
  misc_feature: GZ8MTXP02F52RG.8.10.A10.1.454.CMB.2.raw
  modified_base (197)..(197): a, c, t, g, unknown or other
  misc_feature (197)..(197): n is a, c, g, or t
  modified_base (386)..(386): a, c, t, g, unknown or other
  misc_feature (386)..(386): n is a, c, g, or t
  modified_base (431)..(431): a, c, t, g, unknown or other
  misc_feature (431)..(431): n is a, c, g, or t
tcagctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccgaggggaaanacgccaccctctcctgcagggccagtcttagtgttagctaacttagcctggtaaccaacagaaacctggaccaggcctcccaggcctcctcactctctgaatacactaccaacgacgggccacgtggacactccccgagcctaggtcaggtggcaggtgggtctcgggacagtacttcactctacaccntcagcagcctagacgctagattatttgacttactttatactgtanagtacagtacgtagtaacgttcgttaccttctacgttccgcccgtaggaacctaaggtgtatacgtacaaaaccgtagtggtgactcgacacctatccgtattccttctacttcccttcccgactacgtctacgg

SEQ ID NO: 345489 - DNA, 667 bp, Homo sapiens
  misc_feature: GZ8MTXP01CQP6P.52.80.H03.1.454.CMB.2.raw
tcagcgcagtacgacacgaccggtgctcgatttagctgtgcgtcgaagggaaaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgaccaacccactattcttattggtaccagcagaagccaggccacggcccctgtgttgtgatatataaagacactgagaggccttcgagggtatcccgtgacgcgtcttctcctggctccgacctcgaaagggacaagtggtaccaacgtattacgaccatcagttggagtccgaggcaaggaagacgaggctgacttattcgtacgtactaaacttcgtttacagtaacctagttaccgtagttacggttacttaagttcggttaccgtttacgggaaacccgtttcgggggaaaccccttaaacggggttccctaaaccccgggttcccgttaaacgggggttcccttaaaccgggtaaccccccgtaaaaaccggggccccccgttaaaaacccccccgtctttacccggtaaccccgttaacccctttttcccccgg

SEQ ID NO: 345490 - DNA, 499 bp, Homo sapiens
  misc_feature: GZ8MTXP01E4ASW.52.80.H03.1.454.CMB.2.raw
  modified_base (261)..(261): a, c, t, g, unknown or other
  misc_feature (261)..(261): n is a, c, g, or t
  modified_base (405)..(405): a, c, t, g, unknown or other
  misc_feature (405)..(405): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagcgcagtacgacacgaccggtgctcgatttagctgtgcgtcgaagggaaaggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaanccaggccaggcccctgtgttgttgatatataaagacactgagaggccttcagggatccctgagcgcttctcctggctccacctcaagggacaatggtcacattgaccatcagtgagtccaggcagaagcgaggctgactattcngtcaatcttcagacatcagtggtacttatgtcttcggaactgggaccaggttcacgtcttaggttcagcccaaggcccaacccacngtcnctcg

SEQ ID NO: 345491 - DNA, 541 bp, Homo sapiens
  misc_feature: GZ8MTXP01DR7MN.52.80.H03.1.454.CMB.2.raw
  modified_base (227)..(227): a, c, t, g, unknown or other
  misc_feature (227)..(227): n is a, c, g, or t
tcagcgcagtacgacacgaccggtgctcgatttagctgtgcgtcgaagggaaaggggggtctcaggaggcagcgctctcaggacgtcaccaccatggcctgggctctgctcctcctcaccctcctcactcagggcacagggtcctgggcccagtctgccctgactcagcctccctcgcgtccgggtctcgtggacagtcagtcaccatctcctgcactggatccttnagtgacattggctatttataacttgtctctgtaccaacaacacccggcaaacgccccaaactcatctattttgagtcactaagcgcctcgagggtccctgatcgcttctctcggccctccaagtctggactaaacacggccctaccctgacccgtctcgtgggctccagtctgacgatgaggcggtacttatttcagcatctcatatgcaggcacgataaattcgtcgttcggacggtcgggaacaagtcgttgtacccgttcgtacggtcacgccaggctccgccccgttcggcttacctcgttcgttccccg

SEQ ID NO: 345492 - DNA, 666 bp, Homo sapiens
  misc_feature: GZ8MTXP01A3TA1.52.80.H03.1.454.CMB.2.raw
tcagcgcagtacgacacgaccggtgctcgatttagctgtgcgtcgaagggaaagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgcccaaaccacttattcttattggtaccagcagaagccaggccacggcccctgtcgttgttgattataataaagacactgagagtccttgagggactccgtgagcgcttctcctggctccacctcgaaagggacaagtcgggtaccactactttcgaaccctatccgaagttcgggacttccgaggacaaggaaacgacgagggcctagtaaccttatttacgtcgtactaaacttccttacgaacgtactaactccgtaaggttacggtttaactttaagttcgttaccggtttcgggtaaacgttcggggaaacccttaaacggggttaccctaacccgggttacccgttaacgggttccgaaaccgggaaccccgaaaccggggaacccccttaaacccccggacgttccggtaacccttaacccggtttccccg

SEQ ID NO: 345493 - DNA, 573 bp, Homo sapiens
  misc_feature: GZ8MTXP01AXIX3.52.80.H03.1.454.CMB.2.raw
  modified_base (261)..(261): a, c, t, g, unknown or other
  misc_feature (261)..(261): n is a, c, g, or t
tcagcgcagtacgacacgaccggtgctcgatttagctgtgcgtcgaagggaaagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgcccaaccacttattcttattgtaccagcaganccagccagccctgtgttgtgatatataaagacactgagaggccttcgagggactcctgacgcgtcgttctccgtcggctccacctcgaaagggactaagtcggtacaactattcgaaccatcagtgacgtccgaggcaagaacgcgaagggtctagacttagttctagtacaattcttaccaagactatcgtagttacgttaacttagtacgttcgtacggtaacgtacggaccgtaacggttccgtaaccgtacgttacggttcgaccgaacccgaaccgtccccaaccctcgttacgtccgttccgtccg

SEQ ID NO: 345494 - DNA, 532 bp, Homo sapiens
  misc_feature: GZ8MTXP01BIZ6C.52.80.H03.1.454.CMB.2.raw
  modified_base (265)..(265): a, c, t, g, unknown or other
  misc_feature (265)..(265): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagcgcagtacgacacgaccggtgctcgatttagctgtgcgtcgaagggaaagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattcgaccaaccctacttattcttattggtacagcagaancagcagccctgtgtgtgatatataaagacactgagaggccttcgagggatccctgagcgcttctctggctccaacctcgaacgggactaagtgtacacattacgaccatacagtgagccgaggacagaaacgacgaggtctagacttattctagtcaattctacatacatnagtagtatagtntcgtacggaacgtggaactacggttccgtacgtcgttacgttcgaccgaaccgaacgaacccaacccacttcgtccgttcgtcg

SEQ ID NO: 345495 - DNA, 614 bp, Homo sapiens
  misc_feature: GZ8MTXP01AY676.52.80.H03.1.454.CMB.2.raw
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtcgttgtgatatataaagacactgagaggtccttcgagggactccgtgacgcgtcttctcctcggctcccacctcgaacgggacaagtggtacactattcgacatcagtggacgtcgaggcaaggaagacggaggctagacttattcgtagtactaacttcttacgagtactagtcgtaggttacggttacttagtcggttaccgtttacgggaaacggttcggggaaacccgtaaacgggttcccgtaaacccggttccgttaacgggttcccaacggaaccccgaacgggtaaccccaaaccccgtacgttacgtaaccgttaacctttcccg

SEQ ID NO: 345496 - DNA, 517 bp, Homo sapiens
  misc_feature: GZ8MTXP01C0M5I.52.80.H03.1.454.CMB.2.raw
  modified_base (312)..(312): a, c, t, g, unknown or other
  misc_feature (312)..(312): n is a, c, g, or t
  modified_base (507)..(507): a, c, t, g, unknown or other
  misc_feature (507)..(507): n is a, c, g, or t
  modified_base (514)..(514): a, c, t, g, unknown or other
  misc_feature (514)..(514): n is a, c, g, or t
tcagcgcagtacgacacgaccggtgctcgatttagctgtgcgtcgaagggaaagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatataataaagacactgagaggccttnagggatcctgagcgcttctcctggctccacctcgaagggacaagtggtcacattgaccatcagtggagtcaggcaagaagacgagctgactattctgtacaatcttacagtacaatctaagtggttacttatgtctttacggaacttggggaccaaaggttccacgtcttaggttcacgcccaaggcccaacccncttctcnctc

SEQ ID NO: 345497 - DNA, 556 bp, Homo sapiens
  misc_feature: GZ8MTXP01BXM48.52.80.H03.1.454.CMB.2.raw
  modified_base (230)..(230): a, c, t, g, unknown or other
  misc_feature (230)..(230): n is a, c, g, or t
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagcgcagtacgacacgaccggtgctcgatttagctgtgcgtcgaaggggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcacatctcctgcactggatccttnagtgacattggctatttataacttgtctctgtacaacaacaccgganaaacgccccaaaatcatctattttgagtcataagcgcctnacgggtccctgatcgcttctntcggcctccaaagtcctggcaaaaaacnccggcctccctgacccgtctcgtgggcttcccagttcngacatgaggccgattattctncatctnatatgcgacgacaacgtaataaattacgtcgtcggacggcggaacgaacgacgacgtaccgttaccgtacgtacgacgccgacgtccgtccgtccccgtccgtccgttacctccgttccgttccc

SEQ ID NO: 345498 - DNA, 706 bp, Homo sapiens
  misc_feature: GZ8MTXP01BHHVZ.52.80.H03.1.454.CMB.2.raw
tcagcgcagtacgacacgaccggtgctcgatttagctgtgcgtcgaagggaaagggggtgggtccaggaggcagaactctgggtgtctcaccatggcctggatccctctacttctcccctcctcactctctgcacaggctctgaggcctcctatgtgctgacacagccaccctggtgtccgtgtcccccaggacagacggccaggatccacctgctcgtggagatgctattcgacccaaaccctattattcttattcggtaccagcagaacgccaggccacggccctgtgttgtgatataataaagacactgagaggtccttcgagggtactcccgtagacgtccgtcttctccgtcggtcctcccgacctcgaaagggaaccaagtcggtacaactattacgacctataccgaggtacggacgtaccgaaggaccgaaaggaaacggacggaggtacgtaggtaaacctttatttacgttacgttaacgttaaactttccgtttaacaacgtaactaacgttaccgtaggtttacggttaactttagttacgttaccgtttacgggaaacgttacgggaaaccgttaaacgggttacccgtaacccggttaccgttaacggggttcccaaccggtaaccccgtaaacccgggaaccccctaaacccccggtacttacccggtaaccccgttaacccttttccccg

SEQ ID NO: 345499 - DNA, 545 bp, Homo sapiens
  misc_feature: GZ8MTXP01ATFEK.52.80.H03.1.454.CMB.2.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctcctggtaccaacaacacccggcaaacgccccaaactcatctattttgagtcactaagcgcctcgagggtccctgactcgcttctctggcctccaagtctggcaaaacaccggcctccctcgacctctctcgggctccagtctgacgatgagcggacttatttcgnctntctntagtntgacagacaacgtaataagttacgtcgtcggcggacggacaagcgttcgtaccgttcgtacgtcacgccgacgcctccgccccgtcgtccttacttccgttccgtccccg

SEQ ID NO: 345500 - DNA, 694 bp, Homo sapiens
  misc_feature: GZ8MTXP01COBUO.52.80.H03.1.454.CMB.2.raw
  modified_base (229)..(229): a, c, t, g, unknown or other
  misc_feature (229)..(229): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctccaccctcctcactcagggcacagggtcctgggcccagtctgccctgactcacgcctccctccgcgtccgggtctcgtggacagtcagtcaccatctctgcactgactcctnagtgactattgctatttataacttgtctctagtaccaacacgaccggacaaacgaccccaatcatctatttgagtcactaagccgcctagacgggtccctgactcgtcttctcgtgtccctaccgaagtcctacggacctaaaaccgccggtccctcccgtacgtacccgttcgtccgtcgggtccctccgtacgttccgtaggtaacgacgttaggaacggtacggttaacttacgtttcgcgtacctaacttccgtaacctaaggttaacgttcggtaaccgtaacgggaaccctaaaccgttaaagtttaaaacgtttccggttaacccggtttccggggaccggaccggggtaaaccaacggtcccgttacgtacccggttaccgtaccgggtaccaccggcccgaaacgtcccgtcccgtccccgtttcggaccttcctttcccgttccggtttcccccg

SEQ ID NO: 345501 - DNA, 768 bp, Homo sapiens
  misc_feature: GZ8MTXP01BKOB6.52.80.H03.1.454.CMB.2.raw
tcagcgcagtacgacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctctgtaccaacaacaccggacaaacgaccccaaatcatctattttgaggtcaactaacgccggccctcgacgggtccctgtactcgtcttctcgtcggtccctaccaagtccgtacggacctaaaacccgacccggtccctccccgtacggtaccccgttccgtccggtcggggtccttacccgacgttacgttacggaaccggtagttacgggaacggggtaccgggttaacttttaacgttttaccggtcgtacctaacgttccctttaccgtaaagtttaacgttcgggacccgtaacggggtaccctaaacccgggttaaattttaaaacgtttacgggttccgtttaccggggaccgggtaccggggaacccaaacggtccgttacgggtaaaccccgttccggttaacgggtaccaccgggttaccccgaacgggtccccgttacccggtccccccgttcgggtaacccttaccccgggttccctttcccggtttaaccccccc

SEQ ID NO: 345502 - DNA, 559 bp, Homo sapiens
  misc_feature: GZ8MTXP01EK03K.52.80.H03.1.454.CMB.2.raw
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (365)..(365): a, c, t, g, unknown or other
  misc_feature (365)..(365): n is a, c, g, or t
  modified_base (434)..(435): a, c, t, g, unknown or other
  misc_feature (434)..(435): n is a, c, g, or t
  modified_base (441)..(441): a, c, t, g, unknown or other
  misc_feature (441)..(441): n is a, c, g, or t
tcagcgcagtacgacacgaccggtgctcgatttagctgtgcgtcgaagggaaaggggggggtctcaggaggcagcgctctcaggacgtcaccaccatggcctggtctctgctcctcctcaccctcctcactcagggcacagggtcctgggcccagtctgccctgactcagcctccctcgcgtccgggtctcgtggacagtcagtcacatctcctncactggatccttnagtgacattggctatttataacttgtctctgtacaacacacccggcaaacgccccaaatcatctattttgagtcactaagcgcctgacgggtccctgatcgtcttctctgccctaccaagtcgtcggaccaaaaccnccgggtcccttccctacgacccgttcgtcgtcgggcctcccagttcagacgatgaggacgtcttattcnncatctntagtatgcgacgacacgtaataattagtcgtcggcggcggacgaacgtcgttcgtaccgttcgtacgtacgacgccgacgtccgtccgtcccgtccgtccgttcctccgttccgtccc

SEQ ID NO: 345503 - DNA, 716 bp, Homo sapiens
  misc_feature: GZ8MTXP01AEWWL.52.80.H03.1.454.CMB.2.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctntgganatgcattcgccaaaccctattattcttattcggtaccagcagaanccaggccaggccctgtgttgtgatatataaagacacgtgagacggtccttgagggtactcccgtgacgtccgtcttccgtcccgtcggtcctacccgtaccgtcgaaacggggtaacctaagtcgggtacctaacgtactttacgacctattaccgaaggttacggaacgtcccgaagggaccgaaaggtaaacggacggaacggtacgttacggttaaacctttaagttttctacggttaacgtaaactttacgttaccaaagtaaccctagttaccgtaaggtttaccgggttaatttacgttacggtttaccgttacgggtaaacgttcggggttaaacccgtaacgggttaccgtaacccggttccgttaacgggttccaacccggaaccccgtaaacgggtcccccaaaaccccgtcttaccgtaacccttaaccgtttccccg

SEQ ID NO: 345504 - DNA, 607 bp, Homo sapiens
  misc_feature: GZ8MTXP01D9PE0.52.80.H03.1.454.CMB.2.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (443)..(443): a, c, t, g, unknown or other
  misc_feature (443)..(443): n is a, c, g, or t
  modified_base (583)..(583): a, c, t, g, unknown or other
  misc_feature (583)..(583): n is a, c, g, or t
tcagcgcagtacgacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcgtggacagtcagtcacatctctgcactgatccttnagtnacattgctatttatacttntctctagtaaccaacaacgacccggacaaacgaccccaaactcatctattttgagtcactagccgcctgacggtccctgactcgtcttctcgtcggccctaccgagtctaggacctaaaccgaccggtccctccgtcgtacccgtctcgtcgggcctccgtagtcgtacgacgagtggacggtacggtactttntcgtacgctaactcttacagttacgtcgacgacggtactaaccgtaattaaacgttcgttcgtcggcggtaccggaaccaaacgtcgacccgtcgttacgtaccgacgaccgacgttccgtaacccgtcccgtcgtaccncttccgttccgttcccctaacccg

SEQ ID NO: 345505 - DNA, 655 bp, Homo sapiens
  misc_feature: GZ8MTXP01AZ9LF.52.80.H03.1.454.CMB.2.raw
  modified_base (231)..(231): a, c, t, g, unknown or other
  misc_feature (231)..(231): n is a, c, g, or t
  modified_base (295)..(295): a, c, t, g, unknown or other
  misc_feature (295)..(295): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagccctccctctgccgtccggtctcgtggacagtcagtcacatctcctgcatggactcccttanagtcgactagttgctattttataacttgtctctgtaccaacaacaccggacaaacgccccaaancatatatttgagtcactagcgcctgacgggtccctgactcgtcttcgtctcggtcctacaagtcctacggaaccaaaccgccggtccctcccgtgacccgttctcgtcggcctcccgtagtcgtacgacgagtggacggtacgtacttntttcncgactacttctacgtacttagtcgacgtaacggacctaacgtaaacttaaaacgtttacgttccgttaccggggtaccgggacccgggtaaaccaacggttaccgtccggttacccgttaccggtaacggcccgttaaccgaccccggtaaacgggccctaaccccggttcccccgtccggttaccctccgtttcccgttccccgg

SEQ ID NO: 345506 - DNA, 648 bp, Homo sapiens
  misc_feature: GZ8MTXP01EC86D.52.80.H03.1.454.CMB.2.raw
  modified_base (229)..(229): a, c, t, g, unknown or other
  misc_feature (229)..(229): n is a, c, g, or t
  modified_base (275)..(275): a, c, t, g, unknown or other
  misc_feature (275)..(275): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagcgcagtacgacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcgtggacagtcagtcaccatctcctgcactgactccttnagtgactattgctatttatacttgtctctagtacaacacaccgganaaacgaccccaatcatctattttgacgttacaacgtaacgccgtaccctcgtaacgggtcccctagtactcgtacttctcgtcgtcccctaccgtagtctacggacccaaaaccgacccgtccctaccccgtggtacccttcgttcgtcgggacctcgtacgtcctagacgtatcggaaggtcgtaacttgttcgcnctacttcactaatnttcggaccaggtaccaaccgtaaatttaaacgttcggtcgttccgggacgggaccggaacccgaagtccgttacggtacccgttacgttacgggtcaccggaccgttaacggtccctaccggtccccgtcgtaccgttccttcccggttaaccttccccccg

SEQ ID NO: 345507 - DNA, 515 bp, Homo sapiens
  misc_feature: GZ8MTXP02JKG3K.52.80.H03.1.454.CMB.2.raw
  modified_base (325)..(325): a, c, t, g, unknown or other
  misc_feature (325)..(325): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcagggatccctgancgcttctcctggcctccacctcgagggacagtggtcacattgaaccatccagtggagtccgagggcaagaagacgaggctagactatttcngtcaatcttanagacatcagtgtacttatgtcttacggaactgggacctaaggtcaccgtctacggtcacgcccgaaggcccaacccatcgtacactcg

SEQ ID NO: 345508 - DNA, 562 bp, Homo sapiens
  misc_feature: GZ8MTXP02GYMDV.52.80.H03.1.454.CMB.2.raw
  modified_base (333)..(333): a, c, t, g, unknown or other
  misc_feature (333)..(333): n is a, c, g, or t
  modified_base (425)..(425): a, c, t, g, unknown or other
  misc_feature (425)..(425): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagagccttcgagggactccctgagcgcttcncctggctccacctcagggacatggtcactattcgacatcagtgagtccgaggcagaagacgaggctgactatttctgtcaattcttacaganatcagttgtacttatgttacgttacggtaacgtcggggtaaccaaacgggttacacccggttcgtaaaccgggttccaacggaaccccgaaaacgggacccccaaaaccccgtactccggtacctaacctttccccg

SEQ ID NO: 345509 - DNA, 498 bp, Homo sapiens
  misc_feature: GZ8MTXP02GFI7G.52.80.H03.1.454.CMB.2.raw
  modified_base (312)..(312): a, c, t, g, unknown or other
  misc_feature (312)..(312): n is a, c, g, or t
tcagcgcagtacgacacgaccggtgctcgatttagctgtgcgtcgaagggaaaggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttnagggatccctgagcgcttctctggctccacctcaggacagtgtacacattgaccatcagtgagtccaggcagaagcgaggctgactatttctgtacaatctcagacatcagtgtacttatgtcttcggaactgggaaccaaggtcaccgtctaggtcagcccaaggcccaacccgatcgtcactcc

SEQ ID NO: 345510 - DNA, 556 bp, Homo sapiens
  misc_feature: GZ8MTXP02GB4JW.52.80.H03.1.454.CMB.2.raw
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataacttgtctctgtaccaacaacaccggcaaacgccccaaactcatctattttgagtcactaagcgcctcgacgggtccctgactcgcttctctggcctccaagtctcggacaaccgacggccctccctcgacccgttctccgtcgggcctccgagtctcgacgagtggaggcgtacttatttctgactatctacattagtgcaggccaaccgtattaaattagtcgttcgggcgtacgggaccaagcgtacgtaccgtcgtacgtcacgccgaaggcctccgcccctcggtccactctccgttccccg

SEQ ID NO: 345511 - DNA, 555 bp, Homo sapiens
  misc_feature: GZ8MTXP02HDH4X.52.80.H03.1.454.CMB.2.raw
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
tcagcgcagtacgacacgaccggtgctcgatttagctgtgcgtcgaagggaaagggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgactattggctattttataactttgtctcctggtaccaacaacacccgggacaaacgacccccaaactccaatcattttgagtcactaagcgcctcaggggtccctgatcgcttctctggcctccaagtctggcaacacggcctccctgacccgtctctcggcctcagtcngaacgngagagtacgtacttacttcgtnctactctactatatgagacgacaacgtaataagtacgtcgtcggacggacggacgacgacgtacgtaccgtacgtacgacgacgaccgacgccgtccgtcccgtccgtacctacctccgtcctccc

SEQ ID NO: 345512 - DNA, 588 bp, Homo sapiens
  misc_feature: GZ8MTXP02JFLT9.52.80.H03.1.454.CMB.2.raw
  modified_base (423)..(423): a, c, t, g, unknown or other
  misc_feature (423)..(423): n is a, c, g, or t
tcagcgcagtacgacacgaccggtgctcgatttagctgtgcgtcgaagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctcctgtaccaacaacaccgggcaaacgcccccaaactcatctattttgagtcactaagcgcctcgacggggtccctgactcgcttctctgccctcagtctggacaacacggcctccctgacccgtctcctgggctcccagtctagacgatggagcgtactagtttcngactacttctatatagtcgacgacggactaacgtaattaaacgttacgtcgttcgggacgggaccggaaccgtaacgccgtacggtacccgttaccgtacggtaccgaccgacccgaacggtcccgtcccgccccgttacgtcctaccgttccgtccgtcccccg

SEQ ID NO: 345513 - DNA, 560 bp, Homo sapiens
  misc_feature: GZ8MTXP02IYPX2.52.80.H03.1.454.CMB.2.raw
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggcaggatcacctgctctgganatgcattcgaccaaccctattnttcttagttcggtacagcagaagcaggccacggccctgtgtgtgatatanaagacatgagngccttcgagggntcccgtgagcgtcttctccgtcgcctccactcgagggacagtcgtacacgattcgaccatcgaagtggacgtccgagggacaagaaacgacggaggtctagtacctattttcgattactaaacttcttacanacctagtcctagttggtaactttntcgtacgtacggtaacgtacggaacgtacggtcctaccgtcgtacgtcaacgcccgaaaccgacccaacctacgtactacctacttccg

SEQ ID NO: 345514 - DNA, 548 bp, Homo sapiens
  misc_feature: GZ8MTXP02IEYAC.52.80.H03.1.454.CMB.2.raw
  modified_base (320)..(320): a, c, t, g, unknown or other
  misc_feature (320)..(320): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccatattcttattggtaccagcagagccagccaggcccctgtgttgtgatatataaagacactgagaggccttgagggatcccngagcgtcttctctgctccacctcagggacatggtcacattcgaccatcagtggatccaggcagaagacgagctgactatttctgtcaattcttacagacatcagttggtactttagtcgttacgttcggaaacgttgggacctaaaggttcccaacgttcccgtacgggttccaacggaaccccgtaaacggaccccaaaacccctacgtccgtaccaacctttcccg

SEQ ID NO: 345515 - DNA, 517 bp, Homo sapiens
  misc_feature: GZ8MTXP02HE7JF.52.80.H03.1.454.CMB.2.raw
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (403)..(403): a, c, t, g, unknown or other
  misc_feature (403)..(403): n is a, c, g, or t
tcagcgcagtacgacacgaccggtgctcgatttagctgtgcgtcgaagggaaaggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccntattctatgtacagcagancagcagccctgtntgtgatatataaagacactgagaggtccttgagggatcccgtgagcgtcttctccgtggctcccacctcaaggggacagtcggtacacatgacatcagtgagtccaggcaagaagacgaggtcagactatttcngtactattctacagacatactagtagtattatagtcgtacgtacgtacggtacgtaacgtacgtacgtacgtacgtacgacgaaccgaacgaccgaccacgtacgtactactcg

SEQ ID NO: 345516 - DNA, 547 bp, Homo sapiens
  misc_feature: GZ8MTXP02JJX50.52.80.H03.1.454.CMB.2.raw
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctctgtaccaacaacaccggcaaacgccccaaactcatctattttgagtcactaagccgcctcgacggggtccctgactcgcttcnctcggcctccagtctggacaacgacggccctcccgtgacccgtctcgtcggcctccagtctgacgatgaggcgactattcngcatcacatatgcaggcacgataattagtcgtcggcgacggaccaaacgtcgaccgtcctaggtaccacgtacccgaaggcctccgccccctacggtccaccgtcgttccgtcccctaaccccg

SEQ ID NO: 345517 - DNA, 605 bp, Homo sapiens
  misc_feature: GZ8MTXP02I8QDR.52.80.H03.1.454.CMB.2.raw
  modified_base (436)..(436): a, c, t, g, unknown or other
  misc_feature (436)..(436): n is a, c, g, or t
tcagcgcagtacgacacgaccggtgctcgatttagctgtgcgtcgaagggaaaggggggtctcaggaggcagcgctctcaggacgtcaccaccatggcctgggctctgctcctcctcaccctcctcactcagggcacagggtcctgggcccagtctgccctgactcagccctccctccgcgtccgggtctcgtggacagtcagtcaccatctcctgcactggactccttcagtgacattggctatttataacttgtctctgtaccaacaacacccggcaaacgccccaaactcatctattttgagtcactagcggccctcgagggtccctgactcgtcttctctcggccctccaagtctggacaacgaccggtccctccctcgaccgttcctcgtcgggcctccgtagtcctgacgatcggaggcgacttatttcngactatctcatagtgctaggaccaccgtaaattaaacgttggttacttcgggccggacgggaaccaacggccgttacggacccgttaccgttaacgggtccaaccggtccccgaaacggccctccggtacccccgtcggtaccctaccgttccgttaccgtttcccccg

SEQ ID NO: 345518 - DNA, 558 bp, Homo sapiens
  misc_feature: GZ8MTXP02GUUZ9.52.80.H03.1.454.CMB.2.raw
  modified_base (435)..(435): a, c, t, g, unknown or other
  misc_feature (435)..(435): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctcctgtaccaacaacacccgggcaaacgcccccaaactcatctattttgagtcactaagccggccctcgacgggtccctgatcgcttctctggcctcagtctggcaacgacggccctccctcgaccgtctcgtcgggctccagtctgacgatgaggcgtactattctgctatctcatntgcaggccaaccgtaattaaattgtcgttcggcggtacggaccaagtctacggtacccgttcgtacgtcacgcccgaacggccgtccgacccccgttggtcctaccgttcctcgtttcccccg

SEQ ID NO: 345519 - DNA, 563 bp, Homo sapiens
  misc_feature: GZ8MTXP02IWDSD.52.80.H03.1.454.CMB.2.raw
  modified_base (229)..(229): a, c, t, g, unknown or other
  misc_feature (229)..(229): n is a, c, g, or t
  modified_base (430)..(430): a, c, t, g, unknown or other
  misc_feature (430)..(430): n is a, c, g, or t
tcagcgcagtacgacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctccgccgtccgggtctcgtggacagtcagtcacatctctgcactggatccttnagtgactattggctatttatacttgtctctgtaccacaacaccggacaacgaccccaaatcatctattttgagtcactaagccgtcctcgacgggtccctgactcgtcttctctcgcctccagtctaggacaaccacggcctcctcgaccgtctcgtcgggtcctcgtagtctagacgtaagtggacggtacgtaactttnttcgacgtctacttcctactatacgtgacgacggtaccaacgtaattaacgttcgtcgtcggacggacgaacgacgtcgtcgaccgtacgtacgcgacgacgacgcctcgccctcgtctcttccgtcctcccg

SEQ ID NO: 345520 - DNA, 512 bp, Homo sapiens
  misc_feature: GZ8MTXP02J1S16.52.80.H03.1.454.CMB.2.raw
  modified_base (254)..(254): a, c, t, g, unknown or other
  misc_feature (254)..(254): n is a, c, g, or t
  modified_base (400)..(400): a, c, t, g, unknown or other
  misc_feature (400)..(400): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgccaaccatattcttatgtaccngcagagccaggccaggcccctgtgttgttgatatataaagcactgagaggccttcagggatccctgagcgcttctcctggctccacctcagggacagtggtcacattgaccatcagtgagtccaggcagagcgagctgactattcngtacattctacagacatcgagtggtacttatcgtcgttacggactgggaccaaagggtccaccgtaccgacggtccacgcccaacggccaaccccgatcgtaccacgttccc

SEQ ID NO: 345521 - DNA, 585 bp, Homo sapiens
  misc_feature: GZ8MTXP02JRO42.52.80.H03.1.454.CMB.2.raw
  modified_base (221)..(221): a, c, t, g, unknown or other
  misc_feature (221)..(221): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctgganatgcattgccaacccactattcttattggtaccagcagaagccaggccaggcccctgtgttgtgatatataaagacactgagaggccttcgagggtactccctagacgcgtcttctcccgtgcctccacctcgagggacagtcgtacactattacgaccatcgagtggacgtcgagcgagaagacgagctagtactatttacgtgtacaattcttacgacgtacactcgtagtcgttactagttgttacgtacggtaacgtacgggacctaacgggtaccaccggttacccgtaggttcccgaacgaaccccgtaaaacggggacccccaaaacccggtcctaccggtacctaccgtttacccg

SEQ ID NO: 345522 - DNA, 592 bp, Homo sapiens
  misc_feature: GZ8MTXP02GOQ7X.52.80.H03.1.454.CMB.2.raw
  modified_base (433)..(433): a, c, t, g, unknown or other
  misc_feature (433)..(433): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaacccatattcttattggtaccagcagaagccagccacggccctgtgttgtgatatataaagacactgagaggtccttgagggactcccgtgacgcgctttctccgtggcctccacctcgaagggacagtcggtacactattcgacagtcagtgacgtccaggcaagaagacgagctgacttattctgtactaatcttanagacatcgagttaggtacttagtcgttacgttacggaaacgttcggggaaacctaaacggtccgtaaccccgttccgttaaacgggtccaaaccggtcccccgtaaaacgggaccccctaaaacccccgtaacgtccgttaccgaccttttacccccgg

SEQ ID NO: 345523 - DNA, 545 bp, Homo sapiens
  misc_feature: GZ8MTXP02JYIKG.52.80.H03.1.454.CMB.2.raw
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagcgcagtacgacacgaccggtgctcgatttagctgtgcgtcgaagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatcctcctgcactggatccttcagtgacattggctatttataactttgtctcctggtaccaacaacacccggcaaacgccccaaatcatcattttgagtcactaagcgcctnacgggtccngatcgcttcnctggcctccaagtctcggcaacacggccctccctgaccgtctcgtcgggctcacgtctgacgntgagcgacttattcgngctatcctcatatgacaggacaccgtaattaaactacgttctacggtcggacggacaacgtcgagacccgtctaacggtcacgacccaaagggcctccgcccctcggtccacttccgtcgttcccccg

SEQ ID NO: 345524 - DNA, 625 bp, Homo sapiens
  misc_feature: GZ8MTXP02FUMRZ.52.80.H03.1.454.CMB.2.raw
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggactccttcagtgacattggctatttataacttgtctctgtaccaacaacaccggacaaacgccccaaactcatctattttgagtcactaagccgcctcgacggggtccctgactcgtcttctcgtcggcccttaccaagttctacggaccaaaccgaccgggtccctccccgtcgacccgttcctccgtcggggcctacccagtcctaggaccgagtggaacggtcggactttacttctgtcacttctacattagtgacacggaccaaccgtaattaaaagttcgtacgttcgggacggaccggggaaccaacgtccgtacgtacccgtacgtacggtaccgacgaccccgaagtcccgttccggcccccgttacggtaccctacctcctaccgtttaccccc

SEQ ID NO: 345525 - DNA, 552 bp, Homo sapiens
  misc_feature: GZ8MTXP02HK9UH.52.80.H03.1.454.CMB.2.raw
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctctgtaccaacaacaccggacaaacgccccaaactcatctattttgagtcactaagcgccctcgacgggtccctgactcgcttctctgcctccaagtctggcaacgacggcctccctgacccgtctcgtcgggcttccagttctgacgagtgagcgtactatttctgctatctcatatgcaggcacgaataaattagtcgttcggcggacggaccaacgtctacgacccgtcgtaacggccacggacccaacggtcctccgcccccgtcggtcctaccgtcttcggtttcccccg

SEQ ID NO: 345526 - DNA, 512 bp, Homo sapiens
  misc_feature: GZ8MTXP02GUHNT.52.80.H03.1.454.CMB.2.raw
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcgagggatccctgagcgctttcncctggcctccacctcgaggacagtggtacacattcgaccatacgagttggagtccgaggcagaaagacgagctagacttatttctgtacattctanagacatcagtgtacttatgtctacggactcggacaggtcacgtctacggtcacgccgacggacccacccatcgtcacttccg

SEQ ID NO: 345527 - DNA, 571 bp, Homo sapiens
  misc_feature: GZ8MTXP02J0G10.52.80.H03.1.454.CMB.2.raw
tcagcgcagtacgacacgaccggtgctcgatttagctgtgcgtcgaagggaaagggggggtctcaggaggcagcgctctcaggacgtcaccaccatggcctgggctctgctcctcctcacccctcctcactcagggcacagggtcctgggcccagtctgccctgactcagcctccctccgcgtccgggtctcgtggacagtcagtcaccatctcctgcactggatccttcagtgactattggctatttataactttgtctcctgtaccaacaacgacccgggacaaacgcccccaaactcatctattttgaggtcactaacgcggccctcgacgggtccctgatcgcttctctggccctccagtctgcaacgaccggccctacccgtcgacccgtctcgtcgggcctcccagtctgacgtagtggagcggtactagtttctgctatctcatagtgcgagaccaacgtaattaaacgttacgtcttccgggcggaccggacaacgctacgaccgtcctacggtcacgacccgaggcctcccgccccgtacgtcctaccgtcctcgttccccg

SEQ ID NO: 345528 - DNA, 540 bp, Homo sapiens
  misc_feature: GZ8MTXP02IZPQZ.52.80.H03.1.454.CMB.2.raw
  modified_base (222)..(222): a, c, t, g, unknown or other
  misc_feature (222)..(222): n is a, c, g, or t
  modified_base (439)..(439): a, c, t, g, unknown or other
  misc_feature (439)..(439): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgacccaaaccctacttattctttattcggtaacccagcagaagccaggccaggcccctgtgttgtgatatataaagacactgagagccttcgagggactcctgacgcgtcttctccgtgcctccacctcgaggacagtgtcactattcgacctatcagtgacgtccgaggcaagaagacgagctacgactatttcagtactaattctanagactatcagtgttaacttgtgtcgttacggacgtcggaccaacggtcctacgtcgtacgtcacgaacccgaacggacccaacccgtactcgtccacttcc

SEQ ID NO: 345529 - DNA, 727 bp, Homo sapiens
  misc_feature: GZ8MTXP02JY7G9.52.80.H03.1.454.CMB.2.raw
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagcccaccctcggtgtccgtgtcccccaggacagacggccaggatccacctgctctggagatgcattcgacccaaccctacttattcttattcggtaccagcagaagccaggccacggccctgtgttgtagatataataaagacactgagaggtccttcgagggtactccctgacgcgtcttcgtccgtcggtcctcccacctcgaacgggacagtcggtacactattcgaacctatacgagtcggacgtcccgaaggaccgaaaggaacgaccggaggtacgtacggtaacttagtttacgtacggttactaaactttccttacaacggtaaactacgttaccgtaaggtttacggtttaaaccgtttagttaccggtttacgtttacccggggtaaaacgtttacgggggaaacccgttaaaaccggggttacccgtaaaccccggtttaccgtaaaccggggttaccccgtaaaccccggggtaaccccgtaaaacccggggacccccctaaaacccccggtaacctttccccggtaaccttaaccccggtttcccccg

SEQ ID NO: 345530 - DNA, 630 bp, Homo sapiens
  misc_feature: GZ8MTXP02GCRJU.52.80.H03.1.454.CMB.2.raw
  modified_base (230)..(230): a, c, t, g, unknown or other
  misc_feature (230)..(230): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagccctccctccgcgtccgggtctcgtggacagtcagtcacatctcctgcactggactccttnagtgacattggctatttataactttgtctctgtaccaacaacaccggacaaacgccccaaactcatctattttgagtcactagccgcctcgacgggtccctgactcgcttctctcggccctaccaagtctacggaccaaccgaccggtccctcccgtcgtacccgttccgtccgtcgggtcctcccgtagtctcgacgtagtggaaggtcgtacttagtttctgtactattcctactatagtcgacgacggacctaaccgtaattaaaacgttgttaccgttcgggacgggtacggaaccgtaacgcgttaccggaccgttaccgtaacggtccgaccggacccgaacggtccgtcccgtacccccgttcggtaccctctttcccgtccggtttcccccg

SEQ ID NO: 345531 - DNA, 575 bp, Homo sapiens
  misc_feature: GZ8MTXP02H98MY.52.80.H03.1.454.CMB.2.raw
  modified_base (449)..(449): a, c, t, g, unknown or other
  misc_feature (449)..(449): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccattattcttattggtaccagcagaagccaggccaggcccctgtgttgttgatataataaagacactagagaggccttcgaggggtactcccgtggacgcgtcttctcgtcggtcctccacctcgacgggacagtcggtacactacttcgacctatcgaggtggagtcccgaggcaagagacgaggctgtactagtttctgtactaatcttanagactatcgagttggttacttagttcgtcgttacgaacgtcgggaccgtaacggtaccacccgttacgtacggtccaaccgaacccgaacggtaccccaaccccgacgttacgacctactttcccg

SEQ ID NO: 345532 - DNA, 613 bp, Homo sapiens
  misc_feature: GZ8MTXP02G9HH3.52.80.H03.1.454.CMB.2.raw
  modified_base (222)..(222): a, c, t, g, unknown or other
  misc_feature (222)..(222): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgacccaaccctattattcttagttcggtaacccaggcagaagccaaggccacggcccctgtgttgtgatatataaagacactgagaggccttcgagggactccctgagcgcttactccgtcgctccacctcgaacgggacagtgtacactattcgacatcagtgacgtcgagacgagagacgnggctagtacttacgtttanctactaacttntcanactataccgtagttacgttaattgtacgttacgttacggtaacggtacgggtaaaccgtacgggttacctaacccggttaccgttaacgggtacctaaccccggaacccgtaaaccggaaccccctaaccccgtaaccggtcgttaaacccctacgtttcccccgg

SEQ ID NO: 345533 - DNA, 594 bp, Homo sapiens
  misc_feature: GZ8MTXP02IUCNS.52.80.H03.1.454.CMB.2.raw
  modified_base (229)..(229): a, c, t, g, unknown or other
  misc_feature (229)..(229): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctctgcactggactccttnagtgacattggctatttataacttgtctctgtaccaacaacacccggacaaacgaccccaaatcatctattttgacgtcaactaacgccgcctacgacgggtccctgactcgcttctcgtcgtccctaccgagtctacggccaaaccgacggtccctcccgtcgacccgttctccgtcgggcctccgtacgtcgtgacgagtcggaggtcgtacttattcngctactctcattangacgacggacaacgtaattaaacttcgtcgttcggcgacggaacctaacgtcgtaccgtacgtacggtacaccgaccaacggcctaacccgtccccgtacggtaccaccgtccgttaccttcccctaccc

SEQ ID NO: 345534 - DNA, 532 bp, Homo sapiens
  misc_feature: GZ8MTXP02FJRU5.52.80.H03.1.454.CMB.2.raw
  modified_base (441)..(441): a, c, t, g, unknown or other
  misc_feature (441)..(441): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataacttgtctctgtaccaacaacaccggacaaacgcccccaaactcatctattttgaggtcactaagccggccctcgacggggtccctgatcgtcttctctggccctccaagtctcggacaaccgacggccctccctcgaccgtctcgtgggcctccagtctgacgatgagcggacttattctgctatctcatntgcagcaaccgataaattgtcgtcggacggcggacagctgaccgtcgtacgtcacgaccaggctcgcccctcggccacgtctccgtccccg

SEQ ID NO: 345535 - DNA, 723 bp, Homo sapiens
  misc_feature: GZ8MTXP02JAHNB.52.80.H03.1.454.CMB.2.raw
tcagcgcagtacgacacgaccggtgctcgatttagctgtgcgtcgaagggaaagggggggtctcaggaggcagcgctctcaggacgtcaccaccatggcctgggctctgctccccctcaccctcctcactcagggcacaggtcctgggcccagtctgccctgactcagcctccctccgcgtccgggtctcgtggacagtcagtcaccatctcctgcactggactccttcagtgactattggctatttataactttgtctctggtaccaacacacccggcaacgccccaactcatcattttgaggtcactaagccgccctacgcggggtccctgatccgctttctccgtcggcctaccccgtaagtccgtggaccaaactccggcccttcccgtcgcccggttctccgtcggggtcctcctacgtccgtgaccgagttggaacgggtcgtacttacgttttccgtcgtactacttcctactatacgtcgtacgaccggtaccgtaaacgtaacgttaaacgtttcggttaccggttaccggggaccgggtaaccgggtaaccgtaacggtacccggttaccggttaaccccggttaccgtaacggggtaacccgtacccggtaaccccgtaacgggtccccgttaacccccggtacccccccggtttaccggttaccccttaccccgtttccccgtttacccccggtttaccccccgttccccg

SEQ ID NO: 345536 - DNA, 664 bp, Homo sapiens
  misc_feature: GZ8MTXP02GOUAI.52.80.H03.1.454.CMB.2.raw
  modified_base (444)..(444): a, c, t, g, unknown or other
  misc_feature (444)..(444): n is a, c, g, or t
  modified_base (558)..(558): a, c, t, g, unknown or other
  misc_feature (558)..(558): n is a, c, g, or t
  modified_base (645)..(645): a, c, t, g, unknown or other
  misc_feature (645)..(645): n is a, c, g, or t
tcagcgcagtacgacacgaccggtgctcgatttagctgtgcgtcgaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcacatctctgcactgactccttcagtgactagttcggacttattttattaacttttgttccttccgttaggtaacccaaaccaaaccgaaccccgggaccaaaaccgaccccccaaaactccaacttaccttagtttttacgacggttaccaacgtaaacgccggtccctacggacgggtaccctgtactcgtcctttcctcgtcggacccctaccgtaacgtcgtacggaccaaaccnccgggtcccctcccgtacgtacccgttctccgtcgggcctacccgtagttcgtacggacgtagttcggacggtaccggtactttagtttcgtgtactattcctactattacgtnacgtacggacaaccgtaataacgttgtacgtcggacggacgactagccgtacaccgtacgtacgacacgccgacgccgtccgtcccncgtccactcctccgtcccc

SEQ ID NO: 345537 - DNA, 601 bp, Homo sapiens
  misc_feature: GZ8MTXP02I97ZH.52.80.H03.1.454.CMB.2.raw
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (446)..(446): a, c, t, g, unknown or other
  misc_feature (446)..(446): n is a, c, g, or t
tcagcgcagtacgacacgaccggtgctcgatttagctgtgcgtcgaagggaaagggggtgggtccaggaggcagaactctgggtgtctcaccatggcctggatccctctacttctcccctcctcactctctgcacaggctctgaggcctcctatgtgctgacacagccaccctggtgtccgtgtccccaggacagacggccaggatcacctgctctggagatgcattgacccaacccacttattcttattggtaccagcagaagccaggccagcccctgtgttgtnatatanaaagacactgagacgcttcgagggtactccgtgagcgtcttctccgtcgctccacctcgacggacacgtcggtacacgtattacgaacctagtacctaggtaggtacgtacccgaggaccaaggaaacgacggaggtctaggtacttatttcgngttacaattcttacagtacagtctagttaggttacttgtacgtcgttacggtaacgtcgggaaacctacggtaccgtaaccggtccgtacgggtcctaaccggaacccgaaccggtaccccaaccccttacgtacgttaccccaacgtttccccg

SEQ ID NO: 345538 - DNA, 749 bp, Homo sapiens
  misc_feature: GZ8MTXP02J01OI.52.80.H03.1.454.CMB.2.raw
  modified_base (337)..(337): a, c, t, g, unknown or other
  misc_feature (337)..(337): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaaccctattattcttagttcgtaccagcagacgccaggccacggccctgtgttgtagatataataaagacacgtgagacggtccttcgagggtactccgngacgtcgtccttcgtccgtcggtcctaccgaccttcggaacgggtaacctagtcgggtactaacgtacgttacgaacctactcggtaaggttacgggtaccggttaccgaaacgggacaaaaggggaaacggtaaccgggtaacgggtaccgttaacgttaaacgtttacgttttaccgtacgttacgtaactttacctacgtaacgtaactacgtacggttaaggttacggtttaacttagttaccgtttacgttaaccggggtaacggttaccgggggaaaccgtaaaccggggttacccgtacccgggttaaccgttaccggaacccggtaacccggtaaccccggtaaacccggacccccgtaaaacccccggttagtacccgttaaccggtaaccctttccccgggg

SEQ ID NO: 345539 - DNA, 642 bp, Homo sapiens
  misc_feature: GZ8MTXP02JV82N.52.80.H03.1.454.CMB.2.raw
  modified_base (238)..(238): a, c, t, g, unknown or other
  misc_feature (238)..(238): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctcttcacaggctctgaggcctcctatgtgctgacacagccaccctcggtgtccgtgtccccaggacagacgccaggatcacctgctcgtggagatgcattgccaaaccntattcttattgggtaccagcagaacgccaggcctaggcccctgtacgttgtcgatatataaacgatactgagaggtccttgaggtatcccgtgacgcgtcttctctccggcctacctacctcgacgggacctaagtcgtaccaactagttacgtaccactctaacggtagtacgtaccgaggacgagaagtacggagcgtagtacttacgttctagtactaaacgttcttacgagtacctatacggtaacgttacggttacttaacgttcggttacgttacgggaacgttacggggaccttaaacgggtcctaccggttaccgtaaacggttccgaaaccgacccgaaacccggaccctaaaaccccgtacggtccgtaccgtaacccttccggtttacccccg

SEQ ID NO: 345540 - DNA, 673 bp, Homo sapiens
  misc_feature: GZ8MTXP02JH9ZY.52.80.H03.1.454.CMB.2.raw
  modified_base (224)..(224): a, c, t, g, unknown or other
  misc_feature (224)..(224): n is a, c, g, or t
  modified_base (652)..(652): a, c, t, g, unknown or other
  misc_feature (652)..(652): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccacccgtcggtgtccgtgtccccaggacaggacggccaggatcacctgctctgganatgcattcgacccaaccctattattcttattcggtaccagcagaacgccgaggccacggtcccctggtgttcgtagatataataaagactacgtgagacggtccttagagggtactcccgtagacgcgtcttcgtaccgtcgcctacccaccgtcgaacggggtaccaggtcggtactaacgtacttcgaacctaagtcgaaggtacggtacgtcccgaggaccgaaaggaacgtacggaacgtccgtaggtaacctttacgtttcgtacgttaactaacgttccttaacacggtaactctagtacggttagttaacgtttacgtcggttaccgttacgggtaaacggttccgggaaaccgttaacggtcccgtaaccggttcgtaacgggtaccaacggtaaccccgaacggtaccccaaacccgtntaccggtacctaccgtttccg

SEQ ID NO: 345541 - DNA, 604 bp, Homo sapiens
  misc_feature: GZ8MTXP02JE57Z.52.80.H03.1.454.CMB.2.raw
  modified_base (420)..(420): a, c, t, g, unknown or other
  misc_feature (420)..(420): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggactccttcagtgactagttggctatttatactttgtctctgtaccaacacaccggcaaacgccccaaatcatctattttgagtcactaagcgcctcgacgggtccctgactcgcttctctcgcctcagtctggacaacgacgcctccgtcgaccgtctcgtcggcctccgagtctgacgatggagcgtatacgtttcngcagttctactatactcgacgacggaccaaccgtaattaaacgttacgtccgttacgggccggaccgggtaacctaacgcgtacggtaacccgttaccgtaacggtaccgaaccggtccccgaaacggtccgtaccccggacccccgttcggtaccctaccgttcccgttccgtttaccccccg

SEQ ID NO: 345542 - DNA, 574 bp, Homo sapiens
  misc_feature: GZ8MTXP02JQGBN.52.80.H03.1.454.CMB.2.raw
  modified_base (425)..(425): a, c, t, g, unknown or other
  misc_feature (425)..(425): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggctatttataactttgtctctgtaccaacaacaccggcaaacgccccaaatcatcattttgagtcactaagcgcctcaggggtccctgactcgcttctctggcctccaagtctggcaacacggccctccctgacccgttctctcgggcttcccagtctagaccgtatggaggcgtactagtttcgngactatctatatgtcgacgacgtacctaacgtaattaaacgttacgtcgtacggacggacggaacacgtcgtacgaccgtacgtacggtaccacgaccgaacggtccgtacccgtccccgtcgtacctaccgttccgtacccggtcccc

SEQ ID NO: 345543 - DNA, 677 bp, Homo sapiens
  misc_feature: GZ8MTXP02I51CZ.52.80.H03.1.454.CMB.2.raw
  modified_base (338)..(338): a, c, t, g, unknown or other
  misc_feature (338)..(338): n is a, c, g, or t
tcagcgcagtacgacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcgtggacagtcagtcacatctcctgcactggatccttcagtgactattggctatttataacttgtctctgtacaacaacaccggacaaacgaccccaaactcatctattttgaggtcactaagccgcctcgacgggtccctgactccncttctctcgccctaccgaagtctcggacaacaccgccctccctcggtacccgtctccgtacgggtcctccgtacgtcctaggaccgagttcgggaagtcggaactttattcgtcgtacacttactactagtacttcgaacctacgggtaactaaacccgttaaaagttaaacgtttacggtaccgtttaccgggggaccggacccgggtaaaaccccgtaaaacgtcccggttaaaccccgttacggtaaccgggtaccaccggtaacccgtaacccggtccgtaacccgtccccccgttacggtaaccctccgtttaccttcccgtaccccctacccc

SEQ ID NO: 345544 - DNA, 675 bp, Homo sapiens
  misc_feature: GZ8MTXP02GACZM.52.80.H03.1.454.CMB.2.raw
  modified_base (388)..(388): a, c, t, g, unknown or other
  misc_feature (388)..(388): n is a, c, g, or t
tcagcgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatccacctgctctggagatgcattcgaccaaccctatattctagttgtacagcagacgcagccacggccctgtgtgtgatataataagacacagagagccttacgagggtctccgtgagcgtcttctccgtgtcctacgacctcgacggaactagtcggtacaaccgtagttcgaaccgtanacgagtacggacgtcccgaaggcgaaagtaacgggaaccggacgtacgtacgtaaacttacgtttacgtacgttactaaactttccgttactaaacggtaacctaacgttccgtaaaggtttcggtttaacgtttaaagtccggtttaacgttaccgggttaaaacgtacgggggtaaacccgttaaacgggtacccgtttaacccgggtaccgttacggtacctaaccgggtaacccccgaaacgtacccccgaacctaccctacggttacctaacggtttccccg

SEQ ID NO: 345545 - DNA, 503 bp, Homo sapiens
  misc_feature: GZ8MTXP01DTT4X.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgaactgaataaatatgctggctggtatcggcagaagccaggccagtcccctgtgttggtcatctatcaggataccaagccggccctcagggactcccctgacgcgattctctggctccaaactctagggaacacagccactctgaccatcaagcgggactcgaggctatcgatgggaggctgactatactgtcgaggcgtggacagccgcgacgttggggtacttcgggcggaggggacccaggctgacgtcctgagttcaacgccgaacggg

SEQ ID NO: 345546 - DNA, 536 bp, Homo sapiens
  misc_feature: GZ8MTXP01DWQUB.51.47.E03.1.454.CMB.2.raw
  modified_base (222)..(222): a, c, t, g, unknown or other
  misc_feature (222)..(222): n is a, c, g, or t
  modified_base (435)..(435): a, c, t, g, unknown or other
  misc_feature (435)..(435): n is a, c, g, or t
  modified_base (511)..(511): a, c, t, g, unknown or other
  misc_feature (511)..(511): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgacatcacctgttctgganacagattgactgaataaatatgctggctggtatcggcagaagccaggccagtcccctgtgtgtcatctatcaggataccgaagccggccctcgacggactcccgtgagcgtattcctcgtggcctaccaaacctcgtacggggaacacgacgcccaactctacgacccatcgacgcgggactcgacggctatcgatgggaggctgactatacngtcgaggtcgtggacagccgcgacgttggggtacttcgggcgggaagggacccaaggccgttcggacccgttccgnggacgttaccaacgcccgtaacggg

SEQ ID NO: 345547 - DNA, 482 bp, Homo sapiens
  misc_feature: GZ8MTXP01DF79E.51.47.E03.1.454.CMB.2.raw
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgaataaatatgctggctggtatcggcagaagccaggccagtcccctgtgttggtcatctatcaggataccaagcgcctnaggactccctgagcgattctctggctccaactctagggaacacagccactctgaccatcgagcgggactcgaggctatcgatgggagctgactatactgtcaggcgtggacngccgncgttggggtattggcggaggaccagctgacgtcctgagttcaacgccaacgg

SEQ ID NO: 345548 - DNA, 488 bp, Homo sapiens
  misc_feature: GZ8MTXP01DRL2G.51.47.E03.1.454.CMB.2.raw
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (451)..(451): a, c, t, g, unknown or other
  misc_feature (451)..(451): n is a, c, g, or t
  modified_base (473)..(473): a, c, t, g, unknown or other
  misc_feature (473)..(473): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgaataaatatgctggctggtatcggcagaagccaggccagtcccctgtgtggtcatctatcaggataccaagcgccctcagggactccctgagcgattctctggctccaaactctgggaacacagccactctgaccatcagcgggactcgagctancgatggagctgactattacngtcaggcgtgggacngccgcacgttggggtattcgggcggngggaccgagcgtgaccgtctgngttcaacgccgaacg

SEQ ID NO: 345549 - DNA, 541 bp, Homo sapiens
  misc_feature: GZ8MTXP01DMBFL.51.47.E03.1.454.CMB.2.raw
  modified_base (222)..(222): a, c, t, g, unknown or other
  misc_feature (222)..(222): n is a, c, g, or t
  modified_base (345)..(345): a, c, t, g, unknown or other
  misc_feature (345)..(345): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgtctgganacagattgactgataaatatgctggctggtatcggcagaagccaggccagtcccctgtgttggcatctatcagatacagcgcctcagggactccctgacgcgattctctggctccaacttcgngggaacacacgccactctacgaccatcaggcggactcgaggctagtccgattgggacggtctgacttaagttacctggtacagggccgtgggggaccacggcccgcgtaacgttgggggtaacttcgggacgggaacgggaaccgaaagggccgtggtaacccgtccgtaggacgttcgaacgccccgtaaccggg

SEQ ID NO: 345550 - DNA, 575 bp, Homo sapiens
  misc_feature: GZ8MTXP01BX0TO.51.47.E03.1.454.CMB.2.raw
  modified_base (224)..(224): a, c, t, g, unknown or other
  misc_feature (224)..(224): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtcccgtgtccccaggacagacagcgaccatcacctgttctgganacagtattgactagaataaatatgctggctggtatcggcaagagccaggccacgtcccctgtgttggtcatctatcaggataccgagccgcctcgagggacctcccgtgacgcgtattctacgtggcctaccaacttcgtacgggaacacacgcccactctgaccatcgacggccgggactcgaggctaagtcgagtggggacggtctacgtaacttagttaccgtgtaccgaggggtccggtgggaccgacggcccggaacgtaaccgggttggggttacggttcgggacggggacgggttaccgaaggccgtaaggacccgtcgtggacgttcgaaccgccgaaccggg

SEQ ID NO: 345551 - DNA, 492 bp, Homo sapiens
  misc_feature: GZ8MTXP01BV4M4.51.47.E03.1.454.CMB.2.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcngganacagattgactgataaatatgctggctggtatcggcagagccaggccagtcccctgtgttggtcatctatcaggactaccaagcggccctcgacggggactccgtgacgccgaattcctcgtggcctccaactcgtaggggaacacacgccactctcgaccatcagcgggactcgagctatcgagtgaggctagactattactgtcaggtcgtggacngccgnacgtgggttatcgggcgagggcagctgccgtctgcgtcgcgcccg

SEQ ID NO: 345552 - DNA, 552 bp, Homo sapiens
  misc_feature: GZ8MTXP01BE5DX.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
  modified_base (538)..(538): a, c, t, g, unknown or other
  misc_feature (538)..(538): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcngganacagattgactgaataaatatgctggctggtatcggcagaacgccgaggccacgtcccctgtgttggtcatctatcaggataccgaagccggccctagacggggtacctccccgtgacgcgtattcctcgtcggcctaccgaaactcgtagggaacacgacgccactctacgaccatcgacggtcgggtactcgaaggctaatcgaatggggacgtctagactattaccgngtcgaggcgtagggacacggcccgngtacggttggggtacttcggggacggagggacccgagccgtgaccgtcgtagcgttacncggcccgtaacggg

SEQ ID NO: 345553 - DNA, 532 bp, Homo sapiens
  misc_feature: GZ8MTXP01EDKJ9.51.47.E03.1.454.CMB.2.raw
  modified_base (263)..(263): a, c, t, g, unknown or other
  misc_feature (263)..(263): n is a, c, g, or t
  modified_base (476)..(476): a, c, t, g, unknown or other
  misc_feature (476)..(476): n is a, c, g, or t
  modified_base (518)..(518): a, c, t, g, unknown or other
  misc_feature (518)..(518): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtcccccaggacagacagcgaccatcaccttgttctggagacagattgactgataaatatgctggctggtatcgganagaagccagccacgtcccctgtgttgtcatctatcaggataccgaacgccgccctcgacggactccgtgacgtccgtaattctcgtgggtcctacccgtaactcgtacggggaaacacacgaccacgtctacgaccatcgaaggccgggactcgacggtactacgttacgagttggacgtcctagtacttattacgtgacgaggtcgtggacngccgcgacgtggggttagtcgggcggaggcacgctgccgtcnggacgtcgcgcccg

SEQ ID NO: 345554 - DNA, 483 bp, Homo sapiens
  misc_feature: GZ8MTXP01C8H48.51.47.E03.1.454.CMB.2.raw
  modified_base (222)..(222): a, c, t, g, unknown or other
  misc_feature (222)..(222): n is a, c, g, or t
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgtctgganacagattgactgaataaatatgctggctggtatcggcagaagccaggccagtcccctgtgttggtcatctatcaggataccaagcggcctcagggactcccctgagcgattcnctggctccaactctgggaacacagccactcngaccatcagcgggactcagcatcgatggaggctgactatacngtcaggcgtgggacagccgnacgttggggtattcggcggaggaccgagctgaccgtctgagttcaacgccaacgg

SEQ ID NO: 345555 - DNA, 624 bp, Homo sapiens
  misc_feature: GZ8MTXP01ES0MU.51.47.E03.1.454.CMB.2.raw
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagcccaccctcagtgtccgtgtccccaggacagacagcgaccatcacctgttctggagacagattgactgataaatatgctggctggtatcggacagaagccgaggccagtcccctgtgttgtcatctatcaggactaccgaagcggccctcgacgggctccgtgacgcgtaactttcctcgtcgggcctcccaaacttcgtacggggaaacaccgacgccctactctacgacctataccgacggccgggaactcgacgggactaacgtcggaaggttggaacgggtcttacggtaaccttagttaccgttggtaccggaggggtccggttacggggaaccacgggcccgtcggttaacgggttcgggggttaacgttcgggggaccggggacggggaaccgttaacgggcgttaccggaacccggttccgacgggacgtccgaacggtaaccccgg

SEQ ID NO: 345556 - DNA, 587 bp, Homo sapiens
  misc_feature: GZ8MTXP01EUSG9.51.47.E03.1.454.CMB.2.raw
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagcccaccctcagtgtccgtgtccccaggacagacagcgaccatccacctgttctggagacagtattgactagaataaatatgctggctggtatcggacaaggaacgccaacggccctacgtcccctggttcgttcggtcattctatcgaggtactaccaacgccggccctgacggactccgtagacgtcgtaacttcctcgtcgggtcctacccgtaactccgtacggggaactaccgacgcctactctacgacccataccgacgggtccgggactcgacggtctagtccgagtggacggtctacgtacttagttcgtgtaccgtagggcggtacggacgcggccgcgttacggtggggttacggtcgggacggggacggccaggtcctaggccgtcgtgaccgtcgaacggtaacccg

SEQ ID NO: 345557 - DNA, 579 bp, Homo sapiens
  misc_feature: GZ8MTXP01AO71Q.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
  modified_base (463)..(463): a, c, t, g, unknown or other
  misc_feature (463)..(463): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcngganacagattgactgataaatatgctggctggtatcggnagaagccaggccagtcccctgtgttgtcatctatcgaagactaccgaaggccgccctagacggggtacctccccgtagacgtccgtactttcctacgttcggccctacccaaacgtcgtacggggaacacgacgcccacgtctacgaccatcgagggcggtactcgaggctagtcgagtacggggagtctagacttacttacgnggtaccgagggcggtacggggacacgggccgctaacgggttgggggtacttcggggacgggagggacccgttaagccgtcggacccgtcgtcggacgttccgcggaacccgaacgg

SEQ ID NO: 345558 - DNA, 567 bp, Homo sapiens
  misc_feature: GZ8MTXP01BELMV.51.47.E03.1.454.CMB.2.raw
  modified_base (224)..(224): a, c, t, g, unknown or other
  misc_feature (224)..(224): n is a, c, g, or t
  modified_base (262)..(262): a, c, t, g, unknown or other
  misc_feature (262)..(262): n is a, c, g, or t
  modified_base (488)..(488): a, c, t, g, unknown or other
  misc_feature (488)..(488): n is a, c, g, or t
  modified_base (545)..(545): a, c, t, g, unknown or other
  misc_feature (545)..(545): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagcccaccctcagtgtccgtgtccccaggacagacagcgacatcacctgttctgganacagattgactagataaatatgctggctggtatcgganaggaagccgaggcccacgtcccctggtgttcggtcatctatacaggtactaaccaacgtccggccctcgaaccggggactccgtggacgcgtaactttctcgtggcccttacccaacgttcgtacggggaaacacacgcccaacttcacgacccaagtccgaggtcgggactacgaggcctagtcgagtggacggtctagactattacgtgtcgaggtcgaggacncggccgcgaggtcggggttacgtcggggacggacggggcacggcgtcgtccgtccgngttacggtcgaacgtaacccgg

SEQ ID NO: 345559 - DNA, 593 bp, Homo sapiens
  misc_feature: GZ8MTXP01EMU8R.51.47.E03.1.454.CMB.2.raw
  modified_base (222)..(222): a, c, t, g, unknown or other
  misc_feature (222)..(222): n is a, c, g, or t
  modified_base (263)..(263): a, c, t, g, unknown or other
  misc_feature (263)..(263): n is a, c, g, or t
  modified_base (327)..(327): a, c, t, g, unknown or other
  misc_feature (327)..(327): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtgtccccaggacagacagcaccatcacctgtctgganacagtattgactagaaataaatatgctggctggtatcgganagaagccgagccagtcccctgtgttgtcatctatcgagataccagccgacctgaggacctcccngacgcgtattcctcgtcggcctaccgaactcgtacgggaaccacacgacccacttcacgaccatacgacggcggactcgaggtctagtacgagtggggaacgtcgtagacttagttaccgtggtaccgagggtcggtggaccacggcccggaagtaacgggttggggtacgggttccggggacgggtaacgggaaccccgaggttaccgtcgggaaccccgtttcccgtaggaccggttaccgaacccggttccccgtaacccggg

SEQ ID NO: 345560 - DNA, 668 bp, Homo sapiens
  misc_feature: GZ8MTXP01DO1U8.51.47.E03.1.454.CMB.2.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (419)..(419): a, c, t, g, unknown or other
  misc_feature (419)..(419): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgccaccctcagtcgtccgtcgtccccaggacagacagcgaccatcacctgtcngganacagattgactagaataaatntgctggctggtagtcggacaagaacgccgacggcctacggtcccctgtgttggcattctatcgaggaactaccgaagtccgccctgacggtacctcccgtagacgcgtactttcctcgtggccctacccaacgtcgtacgggaaacacgacgccctaactcctacgaacctanaccgacggaccgggtactcgacggtctaagtcgagtacggggaacggtacttagtaacttaacgttaccgtggttaccggaacggggtccggttacggggaaaccgtccggacccggtcggtaacggggtttgggggttaaccgggttccggggaaccggggtaacggggaacccgaacgggttccccgttaacgggtaaccccggttcgttacgggacggttaccgaaccggaacccccgtaaccggg

SEQ ID NO: 345561 - DNA, 586 bp, Homo sapiens
  misc_feature: GZ8MTXP01BESP9.51.47.E03.1.454.CMB.2.raw
  modified_base (384)..(384): a, c, t, g, unknown or other
  misc_feature (384)..(384): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccacctcagtgtccgtgtccccaggacagacagcgaccatcacctgttctggagacagattgactgaataaatatgctggctggtatcggcagaagccaggccagtcccctgtgttggtcattctatcaaggactaccgaacgccggccctcgacggggacctccccgtaggacgcgtacttctctcggcctacccgaaactccgtagggaaaccncgtacgcccactctacgaccagtcgaacggccgggtactcgaggtctaatcgaatggggaggtctagaccttagttaccgtgtccgtagggcgtacgggacgacggtccgaacgtacggttcgggggtaacttcgggggacggaacggggaccgacggcctcgggtacccgtcgtaggcgttacgaaccgttcccgtaacgg

SEQ ID NO: 345562 - DNA, 684 bp, Homo sapiens
  misc_feature: GZ8MTXP01CELI9.51.47.E03.1.454.CMB.2.raw
  modified_base (177)..(177): a, c, t, g, unknown or other
  misc_feature (177)..(177): n is a, c, g, or t
  modified_base (225)..(225): a, c, t, g, unknown or other
  misc_feature (225)..(225): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgcccacctnagtcgtccgtcgtccccaggacagacagcgaccatcacctgtctgganacagtattgactagaataaatatgacgtggctaggtacgtcggacaaggacgcccgaaggccctacgtcccccgtggttcgttggctagtctatcgaaggactaaccgacgtccggccctacgacgggtaccctcccgtagacgtcgtacttcctcgtcgcctaccctaacgttcgacgggaaccacgacgcctactctacgaacctacgacgacggccgggtactcgacgtacgttaactccggtaagtaggggacgggtcttacggtaactttacgttaaacgttcgggtcgtaaaccgggggtcggtaacggggtacctaccggggacccgtaacccgggttaaaggggttcgggggttaaaccgttccgggggtaaccgggaacgggttaaccgaacggttccgtaacggtaacccgtcgttaggaacgttcccgtaaccggccccgtaaccggg

SEQ ID NO: 345563 - DNA, 527 bp, Homo sapiens
  misc_feature: GZ8MTXP01EUJ3K.51.47.E03.1.454.CMB.2.raw
  modified_base (224)..(224): a, c, t, g, unknown or other
  misc_feature (224)..(224): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtgtccgtgtccccaggacagacagcgaccatcacctgttctgganacagattgactgaataaatatgctggctggtatcggcagaagccaggccagtcccctgtgttggtcatctatcaggactaccgaagccggccctcgagggacctcccgtgacgcgtacttctctggcctccaaactcgtagggaacacacgcccactctcgaccatcgacggcgggactcgaggctatcgatgggaggtctagtacttagttctgtccgagggtcgtgggacacgcgctacggttggggtattcgggcggacgggacgagcgtgaccgtctggacgttcaacgttccgaacgg

SEQ ID NO: 345564 - DNA, 623 bp, Homo sapiens
  misc_feature: GZ8MTXP01EOQPT.51.47.E03.1.454.CMB.2.raw
  modified_base (409)..(409): a, c, t, g, unknown or other
  misc_feature (409)..(409): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccacctcagtgtccgtgtccccaggacagacagcgaccatcacctgttctggagacagattgactgataaatatgctggctggtatcggcagaagccaggccagtcccctgtgtggtcatctatcaggactaccaagcgcctcgagggacctcccgtagacgcgtattctctcggtcctacgactcgtgggaaccacacgccactctcgaccatcgacggcgggactcgaggctaagtcgntcggggaggtcgtacgtcttaacgtttaaccgtcggttacggacggggtccgggtacgggggaaccgaccgggccccgggtaaccgtaacggggtttacggggggttaacggtttccggggaaccgggggaacggaaaccccggaacggccggttaaccgggaccccggtttcccgtacgggtaccgttaccgaaccggcccccgtaaacgggg

SEQ ID NO: 345565 - DNA, 697 bp, Homo sapiens
  misc_feature: GZ8MTXP01DLSL8.51.47.E03.1.454.CMB.2.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgacatcacctgtcngganacagattgactagaataaatatgctggctggtactcggacaaggaacgccgaggccctacgtccccgtgttggttggtctatctagtcgaaggactaaccgaacggccggccctacgaaccgggactccgtggacgtcgtaactttcctcgtcggtaccctacccgtaaaccgtccggtaacggggaaaccaccgacgtaccctaaccgttaccgtacggaaccctacgtaccggaacgggtacccggggtaacctaccggaacgggtaccttacgtaccggtaaggttcggaaacggggttcttaacgggtaacctttaacgtttaaccgtggttacccggagggtaccgggtacggggaaccgaccggccggtacggttacgggttacgggggttacgttccgggggacgggttaacggggaaccaacggtccgtacggtaacccgtcggtacgacgtccgaacgaaccccgg

SEQ ID NO: 345566 - DNA, 556 bp, Homo sapiens
  misc_feature: GZ8MTXP01CVHLP.51.47.E03.1.454.CMB.2.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcacgcccaccctnagtcgtccgtcgtccccaggacagacagcgacatcacctgttcnggagacagattgactagaataaatntgctggctggtatcggacaggaacnccgaggccacgtcccctgtgttgtcatctatcagactacgacgcgcctgaggctccngagcgtaattctgtcgcctaccactcgagggaacacgacgccacgtcncgacctancgacggcggactcgacgtctaagtcgaggtcgaggtctacgacttatacgtgtcgacggtcggtacgggaccgcgccggacgttgggttacggggttacggttcggggacgggttaacggaccgacgtaaccgtcgggaaccctcggtcggacgtcgaaccgtaacccgg

SEQ ID NO: 345567 - DNA, 570 bp, Homo sapiens
  misc_feature: GZ8MTXP01A68FQ.51.47.E03.1.454.CMB.2.raw
  modified_base (176)..(176): a, c, t, g, unknown or other
  misc_feature (176)..(176): n is a, c, g, or t
  modified_base (223)..(223): a, c, t, g, unknown or other
  misc_feature (223)..(223): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctnagtgtccgtgtccccaggacagacagcgaccatcacctgttctgganacagattgactgaataaatatgctggctggtatcggcagaacgccaggccagtcccctgtgttgtcatctatcagataccgagccgcctgacggtactcccgtgacgcgtacttcgtctcggcctaccaactcgtacgggaacacgacgcccactctacgaccaatccgaaggccgggaactcgaggcctagcgatgggacggtctgacttagtaccgtgtacgacggtcggtaggacgacggccgaacgtggttcggggttacgttccgggacggggaacgggaaccgaggttccgtaacggtaccccgttcgtcggtaacgttccgaacggttcccgaacccggg

SEQ ID NO: 345568 - DNA, 606 bp, Homo sapiens
  misc_feature: GZ8MTXP01CKPIG.51.47.E03.1.454.CMB.2.raw
  modified_base (226)..(226): a, c, t, g, unknown or other
  misc_feature (226)..(226): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtcgtcccgtcgtccccaggacagacagcgaccatcacctgtctgganacagattgactagaataaatatgctggctggtatcggcagaagccacggccacgtcccctggtgttggtcatctatcgaggaactaccgaagccgccctcgacgggtacctcccgtggacgtcgtacttccgttcgtcggccttacccgaacgttccgtacggggaaacctacgaaccgtccctaactcgtacgaccagtccgacggtccgggactcgacggtctaagtcgaagtggggacggtctagtaacttattaaccgtgtacgacggcggtacggacgcggcccggaacgtacgggttggggttaacttcggggacgggacgggaccgaacgttccgtaacggcccgtcgtcgacgttcgaacgcccgtaaccgg

SEQ ID NO: 345569 - DNA, 666 bp, Homo sapiens
  misc_feature: GZ8MTXP01AMJ3W.51.47.E03.1.454.CMB.2.raw
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (262)..(262): a, c, t, g, unknown or other
  misc_feature (262)..(262): n is a, c, g, or t
  modified_base (345)..(345): a, c, t, g, unknown or other
  misc_feature (345)..(345): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtgtccccaggaccagacagcgaccatcacctgttctgganacagnttgactgaataaatatgctggctggtatcggnagaacgccaggccacgtcccctgtgtggcatctatcaggactaccgagccggccctcgacgggactcccgtgacgtcgattcnctcggcctaccgtaactcgtagggaacacgaacgcccaactctacgaccctataccgacggaccgggactaccggagggctttaacgtaccggagttacgggggacggggtccttacggtaacctttaacgtttaacccgtgggtttacccggaagggggtcccgggttacgggggacctacgggtccccgggaacggtaaccgggtttggggggttaccgttaccggggggacggggtaaccggggacccgaacgggttccgtcgggtaaaccccggtcgttacggacgggttccaaacccgggccccgtaaaccggggg

SEQ ID NO: 345570 - DNA, 599 bp, Homo sapiens
  misc_feature: GZ8MTXP01ARDV4.51.47.E03.1.454.CMB.2.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
  modified_base (443)..(443): a, c, t, g, unknown or other
  misc_feature (443)..(443): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtgtcccgtgtccccaggaccagacagcgaccatcacctgtctgganacagattgactgaataaatatgctggctggtatcggnagaagccaggccacgtcccctgtgttggtcatctatcaggactaccgaagccggccctcgacggggtacctccccgtaggacgcgtactttcctcgtcggcccttacccaaacgttccgtacggggaacacgaacgccctactctacgacctatcgaacggcgggtactcgaacggtctancgtatggggaagggtctagaccttaattccgtggtaccgagggtcggtgggaccgtacggccgaacgtaacggttgggggtaccgttcggggaccggggaacgggaacccgaggccgttcgaccgttccgtggacgttccgaacgcccgaaccggg

SEQ ID NO: 345571 - DNA, 609 bp, Homo sapiens
  misc_feature: GZ8MTXP01DAPQI.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (574)..(574): a, c, t, g, unknown or other
  misc_feature (574)..(574): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgcccacctcagtcgtccgtcgtccccaggacagacagcgacatcactgtcngganacagtattgactgaataaatatgctggctggtatcggacaaggaacgccgacggccctacggtcccccgtggttcggtttcggtctattacctagtaccgaagggtaactaacccgaaacggtcccggaccccgtacgacggggtacccttccccgtgacgcgtacttctcgtcggacctaccgaacttcgacgggaacacgacaccactcacgacacgtcgaacggcgggtactccgaagggtcctagttacgagttggggaacggtccgttaggtaaccttattaccgtgtaccgagggcgtcgggacacggcgcgtacggttgggtacgttcgggacggacggaccgngccgtgaccgtcgtagcgttcgaacgccgaaccgg

SEQ ID NO: 345572 - DNA, 555 bp, Homo sapiens
  misc_feature: GZ8MTXP01D31LO.51.47.E03.1.454.CMB.2.raw
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgaactgaataaatatgctggctggtatcggcagaagccaggccagtcccctgtgtgtcatctatcagatacaagcggcctnaggactccctgancgattcnctggctcaaactctgggaacanagccatctgaccaanacacgcggacgtacgacgactactacgtagtaggagtacgtacgtacgtaacttaacgttacgtacgtacggtcggtagggacgacgccgcgtacggttacggggtacggttacgggtacgggtaacgggaaccggaacggacgtaacgtaccgtccgtcgtacgttacgtaacgaacccgtaacgg

SEQ ID NO: 345573 - DNA, 670 bp, Homo sapiens
  misc_feature: GZ8MTXP01B80BL.51.47.E03.1.454.CMB.2.raw
  modified_base (178)..(178): a, c, t, g, unknown or other
  misc_feature (178)..(178): n is a, c, g, or t
  modified_base (227)..(227): a, c, t, g, unknown or other
  misc_feature (227)..(227): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgcccaccctnagtcgtccgtcgtccccaggacagacagcgaccatcacctgttctgganacagtattgactagaaataaatagtgcgtggcgtggtagtcggacaagaacgccgacggcctacgtcccctgtcggttggtcatctagtcgaggaactaccgaacggcccggtacctacggacgggtaccctcccgttaggacgtccgtacttccgttcgtcgggtacctacccgtaacgttacggaacgggaacacgacgtaccctacgtcctacgacacgtcgaacgggtccgggacgtcggacctagtcgtagtggacggggtctacggtaactttacgttacgtgtacggacgggtcggtacgggcacggtcccggtgtaacccggggttgggggttaccggtccgggggacgggtaaaccggggaccgaacggttccgttaccgggtaacccgttacggtgtaccggtccgaaccggtaaccccggaacggttccccg

SEQ ID NO: 345574 - DNA, 601 bp, Homo sapiens
  misc_feature: GZ8MTXP01B6PXI.51.47.E03.1.454.CMB.2.raw
  modified_base (177)..(177): a, c, t, g, unknown or other
  misc_feature (177)..(177): n is a, c, g, or t
  modified_base (475)..(475): a, c, t, g, unknown or other
  misc_feature (475)..(475): n is a, c, g, or t
  modified_base (579)..(579): a, c, t, g, unknown or other
  misc_feature (579)..(579): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctnagtcgtccgtcgtcccaggacagacagcgaccatccacttgttcgaggagacagtattagactagaaataaatatgctggctggtatcggacaagaacgccgacggcctacgtccccgtggttcgttggtctatacgtatcaagggactaaccgacgccgtcccgtcgacggtaaccgtcctgtaggccgtactttcctcggtcggtcctacccgtaacgtcgtacggaacacgacgaccctactcctacgacgtactacgacggacggtactcgacgactacgacgtagtacggggnggtctacggtacttacttaacgtccgtagtacggcggtaggacgacgcgtcgaggttgggtcggttcggacgggagggaaccgttggaccgttcggccgttcgngtcgacgaaccgccggaaccgg

SEQ ID NO: 345575 - DNA, 673 bp, Homo sapiens
  misc_feature: GZ8MTXP01DC8N6.51.47.E03.1.454.CMB.2.raw
  modified_base (178)..(178): a, c, t, g, unknown or other
  misc_feature (178)..(178): n is a, c, g, or t
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagcccaccctnagtcgtccgtcgtcccccgaggacagacagccgaccatcaccttgttcgtgganacagtattagactagaataaatatgctggngtaggtatcgganagacgccgacggcctacgtccctgttcgttgtcatctatacgaggactaccgacgccgccgtcgacggcctccgngacgcgtaacttcncgtcgtaccctacccgtaacgtcggacgggtaaaccaccgacgaccctacgtccgtacgaaccctagtaccgacgggaccgggtactacggacgtactacgtaccggtaggtacgggtacggtacttacggttaactttacgttaccgtggtaaccggtacgggtcgggtacggaaccgccgggtaaccgtacggttacggggtttacggggttacggggttacggggcccggggaaacgggttacccgaacgggttcccgtaaccgggtccccgtaggtacggaccgttcccggaaaccgtccccggg

SEQ ID NO: 345576 - DNA, 682 bp, Homo sapiens
  misc_feature: GZ8MTXP01AS769.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcngganacagtattgactgaataaatntgctggctggtatcggacaagaacgccgaggccctacgtcccctggttgttggtcatctatcgaggactaccgagccggaccctgacgggtacctcccgtagacgtcgtattcctcgtcggccctacccgaaacttcggtacgggaaacacgaaccgccctaacgttcctacggtaacccacgtaccgaacgggtaccggggtaacttccgaaacgggtcccttaaaggttccggaaagttcgggggaacggtcccttagggtaaccctttaagttaccgtcggtacgtaacggggtccgggttacgggaacctacgggccccggaaggtaacccgggttagggggttaaccgttccgggggaaccggggtaacggaccccgttaggccgttcggacccgttcgtaggacggttaccaacccgttaaccgtaaccggg

SEQ ID NO: 345577 - DNA, 552 bp, Homo sapiens
  misc_feature: GZ8MTXP01ACM1D.51.47.E03.1.454.CMB.2.raw
  modified_base (177)..(177): a, c, t, g, unknown or other
  misc_feature (177)..(177): n is a, c, g, or t
  modified_base (261)..(261): a, c, t, g, unknown or other
  misc_feature (261)..(261): n is a, c, g, or t
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctnagtgtccgtgtccccaggacagacagcgaccatcacctgttctggagacagattgactgaataaatatgctggctggtatcggnagaagccaggccacgtcccctgtgttggtcatctatcaggataccgaagccgcctcacgggactccgtgagcgtaattcctctggcctccaaactcgtagggaacacacgaccactctgacccataccgagtcgggactcgaggtctaactcgagtggaggctaggtactattcngtcagggtcgtaggacnggccgcgttcggtggggttacgttcggggacgggacggggacccttaaaggcccgtacggtaaccccggttcccggtacggacgtccgaaccggtcccg

SEQ ID NO: 345578 - DNA, 651 bp, Homo sapiens
  misc_feature: GZ8MTXP01DGYVA.51.47.E03.1.454.CMB.2.raw
  modified_base (176)..(176): a, c, t, g, unknown or other
  misc_feature (176)..(176): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctctatgaactgactcacgccaccctnagtcgtccgtcgtcccaggacagacagcgacatcactgtcngganacagtattgactagaaataaatgtgcgtggtctggtacgtcggacagaacgccgacggcctacgttcccctggttcgttggtctagttctactacgaaggaactaaccgacggcccgtacccgtcgacgggtaccctcccgaggacgtccgtactttcccgtcgtcggtaccctacccgtaaacgtcggtaaccgggaaccacgaccgacctactcacgaccactcgacggccgtactacgagtacgtagcgagtaggggacgtctacgtacttacttcgtcggtacgacgggtcggtacgggaccgcggtccgtaacggtacgggttcggggtacggttacgggggaccgggaacgggaccgttacgggttaccgttaaccggtcccggtcgtacggaccgttaccggaaccggaacccggtaacccgg

SEQ ID NO: 345579 - DNA, 653 bp, Homo sapiens
  misc_feature: GZ8MTXP01A8636.51.47.E03.1.454.CMB.2.raw
  modified_base (177)..(177): a, c, t, g, unknown or other
  misc_feature (177)..(177): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtgcctcctatgaactgactcagcccaccctnagtcgtccgtgtccccaggacagacagcgaccatcacctgttcngganacagattgactagaataaatatgctggctggtatcggcagaacgccgaggccacgtcccctgtgttggtcatctatcaggtactaccgaacgccggccctgacggactccgtgacgcgtaattccgtcgtcggtcctaccctaaacgtcgtacgggaaacacacgccctaactcgtacgaccagtaccgacggacgggactacgacggtctaacgtcgaaggttcggaggtcttacgtaacgttagttaaccgttggtaccggtaggggtacccggtaggggaccctaacgggcccggtacggttaaccggggttacgggggttacgttaccgggggacgggttaaccgggggttaccgaaacgggtccgttaccggggtaacccgtttcggacggttaccggttaaccgaacccgggtaaccccggg

SEQ ID NO: 345580 - DNA, 573 bp, Homo sapiens
  misc_feature: GZ8MTXP01C1DW0.51.47.E03.1.454.CMB.2.raw
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (413)..(413): a, c, t, g, unknown or other
  misc_feature (413)..(413): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtgcctcctatgaactgactcagccaccctcagtgtcccgtgtccccaggacagacagcgacatcacctgttcnggagacagattgactgaataaatatgctggctggtatcggnagaacgccaggcccagtcccctgtgttggtcatctatcaggataccaagcggcctcgacgggactccgtgagccgtaattctctcgggctacccaacgtcgtacgggaaacacacgtccactctcgaaccatcaggcggaactcaggcttaancgagtgacggtctagacttaagtctaggtaccaagggtccggtagggaccgacgggccgcgttaccgggtgggggttacgttaccgggggcgggttaacgggggacccaaagggtccgtcggtaacccggtcccgttggaacgtccgaacggaaccccgg

SEQ ID NO: 345581 - DNA, 653 bp, Homo sapiens
  misc_feature: GZ8MTXP01B0OUD.51.47.E03.1.454.CMB.2.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (254)..(254): a, c, t, g, unknown or other
  misc_feature (254)..(254): n is a, c, g, or t
  modified_base (490)..(490): a, c, t, g, unknown or other
  misc_feature (490)..(490): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctctatgaactgactcagccaccctcagtgtccgtgtccccaggacagacagcgacatcactgtcnganacagattgactgaataatatgctggctggtatcggnagagccaggccagtcccctgtgttggtcatctatcaggactaccgaagccggccctagacgggtacctcccgtgacgtcgtacttcctcgtcgggtcctacccgtaaacgtccgtaacggggaaccacgacgccctaactccgtacgacccataccgaacgggccgggtaacctcggaacgggtcttaacgtcggaacgttgggggaacggtcgtacggtaacttacgttaaccgnggttacgaacggggtccggtaaggggaccgtacggcccggtcggtaaaccgggttgggggttaaaccgttcgggggaaccgggtaacgggggaaccccgaaggttccgtaaccgggtacccgttcgtcggaccgttaccgtaacccggaacccggtaaccggg

SEQ ID NO: 345582 - DNA, 775 bp, Homo sapiens
  misc_feature: GZ8MTXP01BKLMO.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcngganacagtattgactgaataaatatgctggctggtatcggacagaacgcccgacggccctacggttcccccgtggttcgtttcggtctacgttctaagttcgaacgggtaactaacccgaaacggtcccggtaccccgtacggtaacggggtacccttacccccggttaggacgtaccggttaacctttcccgttaccggttcgggtaccccttaaccccgtaaaacccgttccccggttaaacgggggaaacccctaaccggaacccggtacccctaaacccttcccgttaacggaaacccccgtaaacgttaccggaaacccgggggccggggtaaacccttaccggaacggggtaccccttaaagtccgggtaaacgtagggggtaaccgggtaccgttacggtaacctttacgttaaccgttcggtacgtaacggggtccggttacggggaccgtacggcccggaacgtacgggttgggggtacgttcggggacgggtacggaccgacggttcgtaacggaccgtccgtgacgttcgaacgcccgtaacgg

SEQ ID NO: 345583 - DNA, 584 bp, Homo sapiens
  misc_feature: GZ8MTXP01C7O3P.51.47.E03.1.454.CMB.2.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (491)..(491): a, c, t, g, unknown or other
  misc_feature (491)..(491): n is a, c, g, or t
  modified_base (539)..(539): a, c, t, g, unknown or other
  misc_feature (539)..(539): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgccaccctcagtgtccgtgtccccaggacagacagcgaccatcacctgttcngganacagattgactgaataaatatgctggctggtatcggacaagaacgccgacggccacgtcccctgttcgttggtcatctatcgaggactaccgaaggccggccctcgacgggtacctccccgtagacgcgtacttcctactcggtcctacccgtaacgtcgtacgggaaccacgacgccctactctacgaccatacgaacggcgggactcgaggtctagtacgagtgggacggtctagtacttagtacgtgtacgaggcggtgggacncggcccgcgtacgggttggggtacgttcggggacgggacgggaaccgnggttccgtcgaccgtcgtaggcgttacaaccggcccgtaaccggg

SEQ ID NO: 345584 - DNA, 673 bp, Homo sapiens
  misc_feature: GZ8MTXP01EXAP2.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgccaccctcagtcgtccgtcgtccccaggacagacagcacatcacctgtcngganacagtattgactgaataaatatgctggctggtatcggacaagaacgccgacggcctacgtcccctagttgtggtcatctatcgaaggactaccgagccgaccctagacgggtaccctcccgtagacgtccgtactttcccgtacgttcggaccctaacccgtaacgttcccgggtaacggggaaacccaccgtaacccgtccctaaccgttccgtacggaaccctaacgttccggaaacgggccggggtaacctacggaacggtactaacgtacgacgttacggggacgtacgtaacggtacttaagttaccgtcggttacgaacgggtccggtagggaccgacgggtccgtcggtaacgggttcggggtaccggttcggggacgggtaacggaaccgttagttccgtaacggtaccgtcgtaggacgttacgaaccgttcccgaaccgg

SEQ ID NO: 345585 - DNA, 552 bp, Homo sapiens
  misc_feature: GZ8MTXP01ER7VL.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtgtccccaggacagacagcgaccatcacctgttctggagacagtattgactgaataaatatgctggctggtatcggcagaagccaggccagtcccctgtgttggtcatctatcaggataccaagcgccctcgacgggactcccgtagagcgtacttctctcggctacccaaaccgttcgtacggggaacacacgcccactctacgaccatcgaacgcgggactcgacggctagtcgatggggacgtcgtagtacttatacgtcgtgacgggtcggtacgggacaccggtcgaacgtacgggttagggtcgttcggggacggacggaccgagcgtcgaccgtcgtgacgttcgaacgcccgtaaccgg

SEQ ID NO: 345586 - DNA, 516 bp, Homo sapiens
  misc_feature: GZ8MTXP01BR09K.51.47.E03.1.454.CMB.2.raw
  modified_base (222)..(222): a, c, t, g, unknown or other
  misc_feature (222)..(222): n is a, c, g, or t
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
  modified_base (422)..(422): a, c, t, g, unknown or other
  misc_feature (422)..(422): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgtctgganacagattgactgaataaatatgctggctggtatcggcagaagccaggccagtcccctgtcgttgtcagtctatcaggataccgaagcggcctnagggactcccgtgacgcgattcnctggcctaccgaactcgtagggaacacgacgccatcagaccatcgagcgggactcgaggctaagtcgatggagctgactatacngtcaggcgtgggacacgccgctacgttggggtattcgggacggagggaccgaaggcgtaacggaccgtccgtaggcgttacgcgcccgaacggg

SEQ ID NO: 345587 - DNA, 574 bp, Homo sapiens
  misc_feature: GZ8MTXP01EYFIM.51.47.E03.1.454.CMB.2.raw
  modified_base (175)..(175): a, c, t, g, unknown or other
  misc_feature (175)..(175): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (456)..(456): a, c, t, g, unknown or other
  misc_feature (456)..(456): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctctatgaactgactcagccaccctnagtcgtccgtgtccccaggacagacagcacatcacctgttcngganacagattgactgaataaatatgctggctggtatcggacaagaacgccaggccacgtcccctgtgttggtcattctatcgaggaactaccgaagccgaccctcgaggacctccccgtagacgtccgtacttccgtcgtcggtccctaccgaacctcggtacgggaaccacgacgcccacttcacgaccatcgacgccggactcgagctagcgagtgggagtctagacttagtacgngtacgaggcgtgggacctcggccgaacgtacggttggggtacgttcggggacgggaacgggaccgaacggccgtaacggtacccgtcgacggaccgttacgaaccggcccgaaccggg

SEQ ID NO: 345588 - DNA, 644 bp, Homo sapiens
  misc_feature: GZ8MTXP01D0B0D.51.47.E03.1.454.CMB.2.raw
  modified_base (222)..(222): a, c, t, g, unknown or other
  misc_feature (222)..(222): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagcccaccctcagtcgtccgtgtccccaggacagacagcacatcacctgtctganacagattgactagataaatatgctgctggtagtcggacagaagccaggccacgtccccgtgttgttcggtcaacgtctatcgtaaggtaactaccgaacggcggaccctcgacgggactccgtagacgtcgtaactttctcgtgtccctaccctaacgttcgaccgggaacncacgtccaccttcncgaaccctagtaccgacgggaccgggtactacgacgaccgttaactccggtaagtacgggtaacgggtcctaggtaccttagttacgtcggttacgacggggtcgtcgggaccgacggcccggtacgttcgggttcgggggttcgttcccgggggtaacggggaacggggttaccaaacgggtcccgtaacggggtcccgttcggtacggacggtcccgaaccggtaaccccgggg

SEQ ID NO: 345589 - DNA, 611 bp, Homo sapiens
  misc_feature: GZ8MTXP01AD9CY.51.47.E03.1.454.CMB.2.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctctatgaactgactcagccacctcagtcgtccgtgtcccaggacagacagcgacatcacctgtcngganacagnttgactgaataaatntgctggctggtactcgganaggacgccgaggccagtccctggtgtgtcntctatcgaggactaccggaacgccggacctaggacggtacctccggtagacgtcgtatccgtcgtcggtacctaccgtaaacgtcggtaaggggaacctacgtacgtaccctacttactacggacctacgtacgaacgggtaccgtactacgacggcttaacggcgtagtgggacggtcttacgtaactttaacgttcgtcggttacgacgggtcgtacgggaccacggtcccgaagtacggttggggtacgttcggggacggtaacgggacgacggcgtaacgggtacctcggtagacgttccgaacggttaaccgaaccgg

SEQ ID NO: 345590 - DNA, 481 bp, Homo sapiens
  misc_feature: GZ8MTXP02FORVD.51.47.E03.1.454.CMB.2.raw
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggcctcagggactccctgagcgattcnctggctcaactctgggaacncacgccactctgaccatcagcgggactcgaggctatcgatgaggctgactatactgtcaggcgtgggacagccgcacgtggggtactcgggcggacgggaccagcngaccgtctgatcacgccaacg

SEQ ID NO: 345591 - DNA, 503 bp, Homo sapiens
  misc_feature: GZ8MTXP02J0XYA.51.47.E03.1.454.CMB.2.raw
  modified_base (313)..(313): a, c, t, g, unknown or other
  misc_feature (313)..(313): n is a, c, g, or t
  modified_base (414)..(414): a, c, t, g, unknown or other
  misc_feature (414)..(414): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtcccgtgtccccaggacagacagcgaccatcacctgttctggagacagattgactgataaatatgctggctggtatcggcagagccaggccagtcccctgtgttggtcatctatcaggataccaagcgccctnagggactccctgagcgattctctggctccaaactcgtgggaacacagaccactctgaccatcagcgggactcgaggctatcgatgaggctgacttattacngtacgagggcgtgggacacgccgcacggtggggtacttcgggcggacgggaccgaagcgcgacccgtccgtagacgtcacggcccacgg

SEQ ID NO: 345592 - DNA, 477 bp, Homo sapiens
  misc_feature: GZ8MTXP02G5KJZ.51.47.E03.1.454.CMB.2.raw
  modified_base (467)..(467): a, c, t, g, unknown or other
  misc_feature (467)..(467): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgtgtcatctatcaggataccaagcgcctcgaggactccctgagcgattctctggctcaactctgggaacacacgccactctgaccatcagcggactcgaggctagtcgatgaggctgactatactgtcaggcgtggacagccgtcacgtgggactcggcggacgggaccaagctgaccgtctagancacgcctagg

SEQ ID NO: 345593 - DNA, 489 bp, Homo sapiens
  misc_feature: GZ8MTXP02JNZUC.51.47.E03.1.454.CMB.2.raw
  modified_base (218)..(218): a, c, t, g, unknown or other
  misc_feature (218)..(218): n is a, c, g, or t
  modified_base (431)..(431): a, c, t, g, unknown or other
  misc_feature (431)..(431): n is a, c, g, or t
  modified_base (467)..(467): a, c, t, g, unknown or other
  misc_feature (467)..(467): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccacctcagtgtccgtgtccccaggacagacagcgaccatcacctgttcnggagacagattgactgataaatatgctggctggtatcggcagaagccaggccagtcccctgtgttggtcatctatcaggataccaagcgccctcaggggactccctgagcgattctctggctcaactctagggaacacagcccactctgaccatcgagccggggactcgagggcctatcgatgaggctggactattactgtcaggcgtggacngccgcacgtggggtactcgggcggacgggacaagcngaccgtctgagcacgccaacgg

SEQ ID NO: 345594 - DNA, 532 bp, Homo sapiens
  misc_feature: GZ8MTXP02HYB1S.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggcatctatcaggataccaagccggccctgacgggactccccgtgacgcgtattctctggctccaactcgtagggaacacacgccactctcgaccatcgacgccgggactcgacggctacgtcgagtggaaaacgtctagtactattactgtacgaggcgtgggacacgccgcgacgtggggtacgttcgggacgggacgggaccgaacggcgtcggaccgtccgtcgacgtcgacgacccgaacggg

SEQ ID NO: 345595 - DNA, 490 bp, Homo sapiens
  misc_feature: GZ8MTXP02JE58U.51.47.E03.1.454.CMB.2.raw
  modified_base (279)..(279): a, c, t, g, unknown or other
  misc_feature (279)..(279): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtccccngtgtggcatctatcaggataccaagcgcctnaggactccctgancgattcnctggctcaactctagggaacacacgccactctgaccatcagccgggatcaggctatcgatgagctagactatactgtacgaggtcgtgggacagcgcgacgtggggtactcgggcggagggaccaagcgtcgaccgtccnggtacncgacgccgtaacgg

SEQ ID NO: 345596 - DNA, 526 bp, Homo sapiens
  misc_feature: GZ8MTXP02HPUM8.51.47.E03.1.454.CMB.2.raw
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggatacaagccgcctcgacgggactccctgacgcgacttctcgtggcctccaaaccttccgtacggggaaacacgacgccaactctagaccatcgacgcggactcgaaggcctaagtcgatggaggctaggaactattactgtcgaggcgtggacgacgccgacgagtcggggtacgttcgggacggacgggaccaaggcgtcggaccgttcgagacgtcacgacccgg

SEQ ID NO: 345597 - DNA, 529 bp, Homo sapiens
  misc_feature: GZ8MTXP02HBYZ2.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccgaagccggccctcgagggacctccccgtgacgcgtattcctctcggcctccaaacttcgtaggggaaaccacgacgaccctactcctacgaaccatccgagccgggactcgaggcctatcgatgaggctgactatacgtgtcgaggcgtgggacagccgcgacgtggggtacttcgggacggacgggaccaaggcgtcgaccgtcgtgacgtcgacgcccgaacgg

SEQ ID NO: 345598 - DNA, 491 bp, Homo sapiens
  misc_feature: GZ8MTXP02IR92A.51.47.E03.1.454.CMB.2.raw
  modified_base (396)..(396): a, c, t, g, unknown or other
  misc_feature (396)..(396): n is a, c, g, or t
  modified_base (471)..(471): a, c, t, g, unknown or other
  misc_feature (471)..(471): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgaataaatatgctggctggtatcggcagaagccaggcccagtcccctgtgttggtcatctattaggataccaagcggccctcgagggactccccctgagcgattctctgctccaactctgggaaccacagccactctgaccatcagcgggactcgaggctancgatgagctgactatactgtcaggcgtggacagcgcacgtggggtatcgggcggacggaccgagctgaaccgtcngacgtcacgccgaagtcccg

SEQ ID NO: 345599 - DNA, 510 bp, Homo sapiens
  misc_feature: GZ8MTXP02G4GZ4.51.47.E03.1.454.CMB.2.raw
  modified_base (223)..(223): a, c, t, g, unknown or other
  misc_feature (223)..(223): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctgganacagattgactgaataaatatgctggctggtatcggcagaagccaggccagtcccctgtgttggcatctatcagatacaagccggccctcgaggactccctgagcgattctctcggctccaactctacgggaacacacgcccactctacgaccatcagccgggactcgagctatcgatgaggtctgactattactgtcgaggcggtggacagccgcgacgtggggtactcgggacgggacgggacccaaggctcggaccgtcgtcggacgtacacggacccgaacgg

SEQ ID NO: 345600 - DNA, 646 bp, Homo sapiens
  misc_feature: GZ8MTXP02J1GYP.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgaataaatatgctggctggtatcggcagaagccaggccagtcccctgtgttggtcatctatcaggactaccaagccgccctcgagggactccccgtgagcgattcgtctgggcctacccaaactcgtacggggaaacacgacggccctactctacgaaccctagtccgacggccggggactacgacgggtacctagttaccggaattgggacgggtcctaggtaacctttaagttaacctggttaccgaaggggtccgggttagggggaaccaacgggcccggacgtaacccggttgggggttaaacggttcccgggggacggggaacgggggaacccaaacggggtacccgtaacgggaacccccggtttccgacgggtaacggtccgaaaccgggccccgtaaaccgggg

SEQ ID NO: 345601 - DNA, 503 bp, Homo sapiens
  misc_feature: GZ8MTXP02G75QD.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgtggtcatctatcaggataccaagccgccctcgagggacctccctgacgcgattctctggcctccaactctagggaacacacgccactctgaccatcagccgggactcgaggctatcgatgaggctgactattactgtctaggcgtagggacagccgcgacgtggggtactcgggacggacgggaccaagcgtcgaccgtcgtagacgtcacgacccaacgg

SEQ ID NO: 345602 - DNA, 591 bp, Homo sapiens
  misc_feature: GZ8MTXP02G9I2J.51.47.E03.1.454.CMB.2.raw
  modified_base (261)..(261): a, c, t, g, unknown or other
  misc_feature (261)..(261): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccatcgtccccaggacagacagcgaccatcacctgttctggagacagattgactgaataaatatgctggctggtatcggnagaagccaggccagtccctgtgtggcatcatcaggataccgaagccggaccctgacggggactcccgtagacgcgtattctcgtcggcctaccaacttccgtagggaaaccacgacgacccactctacgacccagtacgacggcgggtacctcgagggtcctaagtccgaagttcggaggtccttaggaacttagttaccgtggtacgagggtccggtagggaccgacggcccgtacgacgggttcggggttacgtccggggacggggaaccggaccgtaaggtccgtacggtaacccggtcccgtagggaccgtacgacggtaccccgg

SEQ ID NO: 345603 - DNA, 517 bp, Homo sapiens
  misc_feature: GZ8MTXP02JG7A5.51.47.E03.1.454.CMB.2.raw
  modified_base (223)..(223): a, c, t, g, unknown or other
  misc_feature (223)..(223): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctgganacagattgactgaataaatatgctggctggtatcggcagaagccaggccagtcccctgtgttggtcatctatcaggataccaagccgccctcgagggactccctgacgcgattctctggcctccaactcgtgggaacacagcccactctgaccatcagccgggactcgaggctatcgatgaggctgactatactgtcaggcgtgggacaggccgacgacgtgggggtaacttcggggacgggtacgggaccaaggctaacggacccgtcgtacggacgtccacggcccaacggg

SEQ ID NO: 345604 - DNA, 547 bp, Homo sapiens
  misc_feature: GZ8MTXP02G2Y1O.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtcgtccccaggacagacagccgaccatcacctgttctggagacagattgactgaataaatatgctggctggtatcggcagaacgccaggccacgtcccctggtgttggtcatctatcaggactaccaagccgcctcgacgggacctcccgtgacgcgtattcgtctcggcctaccaactcgtacgggaacacgacgcccactctacgaccatcgagccgggactcgaggactatcgatggaggtctagacttatacgtgtacgagggcgtgggacgcgccgacgacggttggggtacgttcgggacgggacggaccgaacggtcgtaacgtaccgtcgacggacgtccacggaccgtaccgg

SEQ ID NO: 345605 - DNA, 493 bp, Homo sapiens
  misc_feature: GZ8MTXP02H0JVY.51.47.E03.1.454.CMB.2.raw
  modified_base (223)..(223): a, c, t, g, unknown or other
  misc_feature (223)..(223): n is a, c, g, or t
  modified_base (420)..(420): a, c, t, g, unknown or other
  misc_feature (420)..(420): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgtctgganacagattgactgataaatatgctggctggtatcggcagaagccaggccagtcccctgtgttggtcatctatcaggataccaagccggcctcgacggggactccccgtgacgcgactttctcgtggctcccaactcgtagggaacacagccactctgaccatcacgcggactcgagctagtcgatgagctgactatcngtcaggcgtggacagccgcacgtcggtagtcggcggtaggaccagcgtcgaccgtctagacgtcgacgacccg

SEQ ID NO: 345606 - DNA, 528 bp, Homo sapiens
  misc_feature: GZ8MTXP02GKQQX.51.47.E03.1.454.CMB.2.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtgtccgtgtccccaggacagacagcgaccatcacctgttcngganacagattgactgaataaatatgctggctggtatcggcagagccaggccagtcccctgtgtggtcatctatcaggactaccgaagccggccctcgacgggacctcccgtagagcgtattcctcgtcggcctaccaaacgtcgtacgggaacacgacgcccactctagaccatcgagcgggactcgagctatcgagtgagctagactatacgtgtacaggcggtggacacggccgacgtacggtgggtacgtcgggacggacggaccgaagtcgtcgaccgtcgtacggacgtcgacgacccacgg

SEQ ID NO: 345607 - DNA, 486 bp, Homo sapiens
  misc_feature: GZ8MTXP02JUD74.51.47.E03.1.454.CMB.2.raw
  modified_base (368)..(368): a, c, t, g, unknown or other
  misc_feature (368)..(368): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcgccctcgaggactcccgtgagcgattctctggctcaactcgtagggaacacacgccactcngaccatcagcgggactcgagctatcgatgaggctgactattactgtcaggcgtggacagccgacacgtggggtatcgggcggaggaccaagcgtcgaccgtctgagtcacgccaacgg

SEQ ID NO: 345608 - DNA, 536 bp, Homo sapiens
  misc_feature: GZ8MTXP02HPW1B.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatccacctgttctggagacagattgactgaataaatatgctggctggtatcggcagaagccaggccagtcccctgtgttggtcatctatcaggatacaagcgcctgacgggctccctgagcgtattcctctggcctccaactcgtaggggaacacgacgccactctgacccatcagcggactcgaggctatcgatgagtctagacttattactgtcagggtcgtgggactagccgactacggttggggtacgttcggggacggtacggggaaccgtaaggccgtaacgaacccggtccgttaggacgtaccgaccgtacccgaaccggg

SEQ ID NO: 345609 - DNA, 589 bp, Homo sapiens
  misc_feature: GZ8MTXP02J25HI.51.47.E03.1.454.CMB.2.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccacctcagtgtccgtgtccccaggacagacagcgaccatcacctgttcngganacagattgactgaataaatatgctggctggtatcggcagagccaggccagtcccctgtgttggtcatctatcaggactaccgaagccgccctgacgggcctcccgtgacgcgtacttcctcgtcggcctacccaacgtcgtaacggggaaccacgacgaccctaactcgtacgaaccctagtccgaaggtccgggaactcgacgggtccttagaccgtagtggacggtctagaaccttagttaccgtggttacgacgggtcggtacgggacgacggccgtcggtaacggtggggtaaccgtcggggacgggacggacccgtaaggccgtcggaacccgtcgtacggaacgccgaccggaccgaacgg

SEQ ID NO: 345610 - DNA, 525 bp, Homo sapiens
  misc_feature: GZ8MTXP02HZY2Y.51.47.E03.1.454.CMB.2.raw
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccacctcagtgtccgtgtccccaggacagacagcgaccatcacctgttctggagacagattgactgaataaatatgctggctggatcggcagaagcaggccagtcccctgtgtggcatctancagatacagcgcctnaggactccgngacgcgtatcnctgcctacactcgagaacncacaccactcacgaccagcgacgacggactcgacggtctacgtacgagtaggacgtactagtacttagttacgcgtacgagggtcggtaggacgacgaccgacgtacggtgggtacgtccggggacgggaacgacgtacgccgtaacggaccgtacgtacgacgtaccgacgaccgacgg

SEQ ID NO: 345611 - DNA, 650 bp, Homo sapiens
  misc_feature: GZ8MTXP02HLO7O.51.47.E03.1.454.CMB.2.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtgtccccaggacagacagcgaccatcacctgttcngganacagattgactgaataaatatgctggctggtatcggcagagccaggcccagtcccctgtgtggtcatctatcaggtactaccgaagccgccctcgacgggacctcccgtgacgcgtattccgtctcgggtcctaccaaacgttcgaacggggaaccacgacgcccactctacgacccataccgacggacgggactacgacgggtactacgtaccggaagttcggacggtaccgttaggtaacccttttaagttaacccgttggttacccggaagggggtccggttacggggaaccacgggcccgtacggttaccgggttagggggttaacgttccgggggaccggggtaaacggggaacccgtaaagggtcccgtaacggtacccccggttgtacggacgtaccgaccggtaacccgtaacccggg

SEQ ID NO: 345612 - DNA, 543 bp, Homo sapiens
  misc_feature: GZ8MTXP02H9OIU.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcactgttctggagacagattgactgaataaatatgctggctggtatcggcagaagcaggccagtcccctgtgttggtcatctatcaggataccaagccggccctcgagggcctcccgtgacgcgattctctggcctcaacgtcgtagggacacacgcccactctacgaccagtcgacgccggggactcgaggcctagcgatggaggtctgacttatctagtcgacggcggtagggacagccgacgtacggttaggggtacttcgggggacggtacggggaccaacggtccgtaacggtacccgtccgtacggacgtcccgacgaccccgaacgg

SEQ ID NO: 345613 - DNA, 554 bp, Homo sapiens
  misc_feature: GZ8MTXP02IHH2S.51.47.E03.1.454.CMB.2.raw
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (408)..(408): a, c, t, g, unknown or other
  misc_feature (408)..(408): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagccgccctcgaggactccctgancgattcnctgggcctccaaactctacggggaacacacgccctaacnctacgaccatccgaaggcgggactcgaggcctancgatgaggctagacttattacctagtcgaggcggtagggacacggccgacgtacggtgggggtacttccggggacgggacgggaacccaaggtccgtaacggaacccggtcccgttaggacgttaccgaacggacccgaaccgggg

SEQ ID NO: 345614 - DNA, 654 bp, Homo sapiens
  misc_feature: GZ8MTXP02F2344.51.47.E03.1.454.CMB.2.raw
  modified_base (259)..(259): a, c, t, g, unknown or other
  misc_feature (259)..(259): n is a, c, g, or t
  modified_base (311)..(311): a, c, t, g, unknown or other
  misc_feature (311)..(311): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggnagaagccaggccagtcccctgtgtggtcatctatcaggataccaagcgcctnagggactccctgagcgattctctcggcctccaaacgtcgtacgggaacacgacgaccctaactcctagaacccctataccgaacggccggggaacttcccgagggtaccctaagttaccggaagttaggacgggtaccttaggtaacctttaacgtttaacccgtgggtttaacccgaaggggtccgggttagggggaaaccctacgggccccggtacggtaaccgggttggggggttaaacgttccgggggaacggggtaaccggggaacccgaaacggtccgttaaccgggaccccggttaccgtacgggacgttccggaaccggtccccgtaaaccgggg

SEQ ID NO: 345615 - DNA, 723 bp, Homo sapiens
  misc_feature: GZ8MTXP02IO6M7.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctctatgaactgactcagccaccctcagtcgtccgtcgtccccaggacagacagcgaccatcacctgttctggagacagattgactagaataaatatgctggctggtatcggacaagaacgccgacggcccacgtccccgtggttcgttggtcagtctagtcgaaggtactaaccgaacggcccggcctacggacggggtaccctcccgtagacgcgttactttccgtcgtcggtcctaccgtaaacgttccgtaacgggaaccaaaccgaccgtaccctaccgttaccgtaccgaaccctaacgtacccggaacggtcccgggggtaaccttacggaacgggtaccttaacggtaccggtaaagtcgggaacggttcgtacggtaactttacgttacgtacggttacggacggggtcgggtacggaaccgaccggacccggtacggtaacggggtttcgggggtaaaccgttccgggggaaccgggggtaaccgggaaccgtaacgggtaccgtaaccgggtacccggttcgtaccgggtaaccgtaccggaccggtaaccccgtaaccgggg

SEQ ID NO: 345616 - DNA, 578 bp, Homo sapiens
  misc_feature: GZ8MTXP02IIFLV.51.47.E03.1.454.CMB.2.raw
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtcgtccgtgtccccaggacagacagcgaccatcacctgttctggagacagattgactgaataaatatgctggctggtatcggacagaagccaggccacgtcccctgtgttggtcatctatcaggatacaagcgcctcgacgggactcccgtgacgcgactttctctggcctccaactcgtcgggaaacacgacgccactctcgaccatcacgcggactcgagctatcgatgaggctgaactagttacgtgtacgagggcgtacgggacgaacggcccggacgtacgggttacggggtaaacggttccgggggacggggtaaacgggggaaccgaaacgggtaacccgtacggtaaccccggttacccggtaggtaccggtaccgaacgggaacccccgg

SEQ ID NO: 345617 - DNA, 518 bp, Homo sapiens
  misc_feature: GZ8MTXP02FUGGK.51.47.E03.1.454.CMB.2.raw
  modified_base (223)..(223): a, c, t, g, unknown or other
  misc_feature (223)..(223): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctgganacagattgactgataaatatgctggctggtatcggcagaagccaggccagtcccctgtgttggtcatctatcaggataccaagcgcctcgaggactccctgagcgattctctggcctccaaactcgtagggaaacacacgcccactctcgaaccatcagccgggactcgaggactatacgatgaggctgactattactgtacgaggcgtggacacgccgacacggttggggtacttcgggacggacgggaccaagcgtaacggacccgttcgacgacgtcgacggacccgaacgg

SEQ ID NO: 345618 - DNA, 505 bp, Homo sapiens
  misc_feature: GZ8MTXP02FXY23.51.47.E03.1.454.CMB.2.raw
  modified_base (176)..(176): a, c, t, g, unknown or other
  misc_feature (176)..(176): n is a, c, g, or t
  modified_base (283)..(283): a, c, t, g, unknown or other
  misc_feature (283)..(283): n is a, c, g, or t
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
  modified_base (494)..(494): a, c, t, g, unknown or other
  misc_feature (494)..(494): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctnagtgtccgtgtccccaggacagacagcgaccatcacctgttctggagacagattgactgataaatatgctggctggtatcggcagaagccaggccatccccggggtntgttgtcatctatcagataccaagccgcctcagggacctcccgtgacgtcgattcctctgggcctccaaacttcgtcgggaaacacgagcccactctagaaccatcgacgcgggactcaggactatcgatgacggctgactattaccgngtcagggtcgtggacaggcccgnacggtgggtactcgggcgagggaccaggctgactcagtncacgacccagg

SEQ ID NO: 345619 - DNA, 669 bp, Homo sapiens
  misc_feature: GZ8MTXP02HWKUL.51.47.E03.1.454.CMB.2.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtcgtccccaggaccagacagcgaccatcacctgttctggagacagattgactgaataaatatgctggctggtatcggcagaagccaggccagtcccctgtgtgcatctancgagatacgaagccgcccngacgggctccgtgacgcgattccnctggctaccactccgtagggaacncaacgccaacgtcctacgaccagttccgaacggcccggggtaacttccgaacgggtaccttacgtaccgagttaggaacgtccgttacgtaacgtttacgtttaaaccgtggttaacccggaagggtccgggtacggggaaccgtaacgggccccggtacgtaacccggggtttagggggttaaacgtttcccggggggaacgggaaaccgggggtaacccggtaaaacggtcccggttaacccgggtaacccgttccggttacggaaaaccgttccccggaaccggttacccccggaaacccgggg

SEQ ID NO: 345620 - DNA, 590 bp, Homo sapiens
  misc_feature: GZ8MTXP02FX9T5.51.47.E03.1.454.CMB.2.raw
  modified_base (177)..(177): a, c, t, g, unknown or other
  misc_feature (177)..(177): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctnagtgtccgtgtccccaggacagacagcgaccatcacctgttctggagacagattgactgaataaatatgctggctggtatcggcagaagccgagccagtcccctgtgttggtcatctatcagactaccgaagccgcctacgacggactcccgtgagcgtatctctcgcctacactcgtacgggaacacacgccactctcgaccatcgagcgggactcgacggtactgtaccgagtggacgggacttacggtaacttagttaaccgtggttacgacggggtacggtcgggaacgacggacccggacgtaccggttagggggttacgttcgggggacggggtaaccgggaaccgaacggaccgtaaccggtacccggtacgttacggacggtaccgaaccggcccgaaacccggg

SEQ ID NO: 345621 - DNA, 629 bp, Homo sapiens
  misc_feature: GZ8MTXP02JTI2B.51.47.E03.1.454.CMB.2.raw
  modified_base (219)..(219): a, c, t, g, unknown or other
  misc_feature (219)..(219): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtgcctcctatgaactgactcagccaccctcagtcgtccgtgtccccaggacagacagcgaccatcacctgttcnggagacagattgactgataaatatgctggctggtatcggcagaagccaggccagtcccctgtcgttggtcatctatcgaggactaccgaacggccgccctcgacgggacctccccgtagacgtcgtattcctcgtcggcctaccgtaacgtcgtaacgggaacacgacgccctaactctacgaccacgtcgacggcggactacgacggacctagtaccgagttacggaagtctacggtacttacgttaacgttggacgtacggggtacggtacgggacgaaccggcccggtacgtaccgggttagggggttaccgttacgggggacggggtaaccggggtaaacccgacggtaccgttaaccggacccggttaccgtacgggtacgtaccgaacggtacccgtaaccggg

SEQ ID NO: 345622 - DNA, 556 bp, Homo sapiens
  misc_feature: GZ8MTXP02HN8SP.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgaataaatatgctggctggtatcggcagagccaggccagtcccctgtgttggcatctatcaggataccgaagccgccctcgaggacctcccgtgacgcgtattctctcggcctccaaactcgtacgggaacacgacgcccacgtctcgaaccatcgaggccgggactcgaggctagtcgatgaggtctagtacgtattacgtgtacgagggtcggtagggacacggcccgacgtacgggttcgggggtacgttacggggacgggacgggaaccgaaggccgtaacggaccgtacgtacggacgtccgacggacccgaacggg

SEQ ID NO: 345623 - DNA, 577 bp, Homo sapiens
  misc_feature: GZ8MTXP02FLS97.51.47.E03.1.454.CMB.2.raw
  modified_base (177)..(177): a, c, t, g, unknown or other
  misc_feature (177)..(177): n is a, c, g, or t
  modified_base (224)..(224): a, c, t, g, unknown or other
  misc_feature (224)..(224): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctnagtgtccgtgtccccaggacagacagcgaccatcacctgttctgganacagattgactgaataaatatgctggctggtatcggacagaagccaggccagtcccctgtgttggtcatctatcaggataccaagccggccctgacggggtactcccgtagacgcgtattctctggcctaccaactcgtacgggaaacacacgccctaacgtctacgaccatcgacggcggactcgaggctagtcgagtggagtccgtagacttaacgttacgtacggtacgaaggggccggtaggggaacacggcccgtcgaaccggttgggggtaacttcgggggacgggtaacgggacccgtaaaggccggtacggtaacccgtcgtaggacgtcccgaacgaccccggg

SEQ ID NO: 345624 - DNA, 647 bp, Homo sapiens
  misc_feature: GZ8MTXP02FX9I5.51.47.E03.1.454.CMB.2.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtcgtccgtcgtccccaggacagacagcgaccatcacctgttctganacagattgactagtaataatgtcngcgtgtagtcgcgagagacncgcgacgtccgtctgtgtcatctatnagacgtactaacgcggccncgaggacgtcccctcgagcgtacttactccgtgtccgtcctaacctcgtaccggaacgacacgcctaaccgtcctcggacaactcgagggacccggcgtaccgacgggtactaccgttacgtaacggtcgtaaagggtcgtacgtacgttaactttaacgttcggtaccgagggtcggggtacgggacgaccggaccggtccgaacggggttcgggttaacggggtttaccgggagggggaacccggaaacggggtaaaacggtcccggaacggtttaaccccggacggtttacgaaccggggtcaaaccgggacccgaaccgggttaccccg

SEQ ID NO: 345625 - DNA, 549 bp, Homo sapiens
  misc_feature: GZ8MTXP02JLEYD.51.47.E03.1.454.CMB.2.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
  modified_base (290)..(290): a, c, t, g, unknown or other
  misc_feature (290)..(290): n is a, c, g, or t
  modified_base (331)..(331): a, c, t, g, unknown or other
  misc_feature (331)..(331): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccacctcagtgtccgtgtccccaggacagacagcgaccatcacctgtctgganacagattgactgaataaatatgctggctggtatcgganagagccaggccagtccctgtgtgtcatctancagactaccagccgcctcgaggcctccgtgacgcgtattcnctcggctcaacgtcgtaggaacacacgacccactctacgaccatcgaacggtccggaactcgagactagtacgagtggacgtctacgtaacttagttacgtcggtacgagggtacggtagggaacgcgacccgtagtacggtaggggtaacgttcgggacgggacggaaccgagtacgtaacgtaaccgtcgtacgacgtaccaaaccggacgtcccg

SEQ ID NO: 345626 - DNA, 559 bp, Homo sapiens
  misc_feature: GZ8MTXP02JX2WG.51.47.E03.1.454.CMB.2.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcactgttcngganacagattgactgaataaatatgctggctggtatcggcagaagccaggccagtcccctgtgttggtcatctatcgaggactaccaagtccggccctacgacggtacctcccgtgacgcgtattctctcggcctaccgaacttcgagggaaccacgacgccctactctcgaccatcgacggcggactcgacggctagtcgaatcggagacgtagtacctattacgtgtacgaggcgtagggacagccgctaacgtggggtacttaccgggacgggacgggaaccgaacggccgtaacggacccgttaccggtagaacgtccgaacggcccgtaaccggg

SEQ ID NO: 345627 - DNA, 709 bp, Homo sapiens
  misc_feature: GZ8MTXP02GVJ0X.51.47.E03.1.454.CMB.2.raw
  modified_base (177)..(177): a, c, t, g, unknown or other
  misc_feature (177)..(177): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (269)..(269): a, c, t, g, unknown or other
  misc_feature (269)..(269): n is a, c, g, or t
  modified_base (336)..(336): a, c, t, g, unknown or other
  misc_feature (336)..(336): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtgcctcctatgaactgactcacgcccaccctnagttcgtccgtcgtccccaggacagacagccgaccatccaccttgtcngganacagtattgactagaataaatatgctggctggtatcgganagacgccagcccagtccctggtgttgctatctatcagactacgacgccgcctagaggtaccctccgngtacgctacttctcgtccggtacctacctaacgtaccgtacgggaaactccgaaaccgtccctactaccgtacacccgtacgtacgaacggtccggactacgaggtaccagttacgagtcggactcgtacggtaacttacttaacgtcggtacggtacggggtaccgggttacgggaaaccgcgggtaccccggtacggttaaccgggggttacgggggttaaacggtttccccggggggaaaacggggtacccgggggaaaaccccgttaaacgggtccccggggttaaaacccggttacccccgggttaacgggttacccggaaccggttaaccccggaaacccggggtaacccccgtttaaccccggggg

SEQ ID NO: 345628 - DNA, 655 bp, Homo sapiens
  misc_feature: GZ8MTXP02F7F2T.51.47.E03.1.454.CMB.2.raw
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtcgtccgtcgtccccaggacagacagcgaccatcacctgttctggagacagattgactgaataaatatgctggctggtatcggcagaagccaggccagtcccctgtgttggtcatctatcaggataccgaacgcgcctcgacggacctcccgtgagcgtattctctggcctaccaacttcgacgggaaacacgacgccactcgtacgaaccataccgaggccgggactacgacggcctaagtccgaagtcggaagggtcttaggaactttaacgttaacctgggttaccgaagggggttaccggtcgggggaaaccgacgggacccggtacggtaacgggttaccggggggtttaaagttcccgggggaacgggtaaaccgggggaaccaaaacgggcccggttaaccgggaaaccccggtccccggttaaacggtccgggttaacccgaaccgggtaccccggtaaaacccgggg

SEQ ID NO: 345629 - DNA, 562 bp, Homo sapiens
  misc_feature: GZ8MTXP02JNQBY.51.47.E03.1.454.CMB.2.raw
  modified_base (219)..(219): a, c, t, g, unknown or other
  misc_feature (219)..(219): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcnggagacagattgactgaataaatatgctggctggtatcggcagaagccaggccagtcccctgtgttggtcatctatcagggataccgaagccggcctcgaggactccctgacgtcgattcctctcggcctccaacttcacggggaacacgacgaccactctacgaccatcagcgggacctgagggctacgtcgatgacggtctagacttataccgtgtacgagggtcggtacgggacgacgcccggtacgaccggttgggggtaacgttccgggggaccgggaacggggaacccaaggccgttcggacccggtaccgtggacgtaccgacggacccgaacggg

SEQ ID NO: 345630 - DNA, 722 bp, Homo sapiens
  misc_feature: GZ8MTXP02H1OJH.51.47.E03.1.454.CMB.2.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (414)..(414): a, c, t, g, unknown or other
  misc_feature (414)..(414): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtcgtccgtcgtccccaggacagacagcgacatcacctgttcngganacagtattgactgtaataatatgctggctggtactcggacaagacgccgacggcctacgtccccgtggtcggttggtacacttcgtactacgaggtactaaccgaacgtccggaccctacggacgggtaccttcccgagacgcgtacttccgtcgtcggctaccacgttcgacggaacacacgcactcncgtaccatcgacggcggactacgacggactagttacgagtacgggagtaccgtaggtaaccttaacgttacggtacggttaaccggaggggttaccgggtaacggggtaacccgacgggttaaccccggtaccggggttaaaccgggggtttacggggggttaaaccgggtttaccgggggaccgggggtaaaaccggggaaacccggtaaaccggggtcccgtttaacccgggggaaaaccccggtttcccggggttaaacggggaacccggttaaccggggtaaacccccggtaaacccccggggg

SEQ ID NO: 345631 - DNA, 695 bp, Homo sapiens
  misc_feature: GZ8MTXP02GW975.51.47.E03.1.454.CMB.2.raw
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccacctcagtcgtccgtcgtccccaggacagacagcgaccatcacctgttctgganacagtattgactagaataaatatgactggctggtacgtcgganagaacgccacggccacgtccccgttggtcgtggtcatctatacgaggactaccgaacggccgtaccctgaccgggtctccgtagacgcgtacttctcgtacgctaccacgtcgtacgacacacgcctactcgtacgacctagtacgacgggtaccggtacgtacgacgggtaccttaaacgtccggttaagacggtaacgtcgttaacgtaacccgttaagtttaccgttacggtaccgtaacggggttccggggtaacggggtaacccgtacgggacccggtacggtacgggggtttacgggggtttaacggtacccgggggtaacccgggggtaaaacgggacccggaaacgggtcccggttaaaccggggtacccccggttacgtacgggttaaccgtacccggtaaaccggtaaccccccggg

SEQ ID NO: 345632 - DNA, 638 bp, Homo sapiens
  misc_feature: GZ8MTXP02JJ179.51.47.E03.1.454.CMB.2.raw
  modified_base (174)..(174): a, c, t, g, unknown or other
  misc_feature (174)..(174): n is a, c, g, or t
  modified_base (241)..(241): a, c, t, g, unknown or other
  misc_feature (241)..(241): n is a, c, g, or t
  modified_base (341)..(341): a, c, t, g, unknown or other
  misc_feature (341)..(341): n is a, c, g, or t
  modified_base (409)..(409): a, c, t, g, unknown or other
  misc_feature (409)..(409): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttctgcacaggatccgtggcctcctatgaactgactcagccacctnagtgtccgtgtccccaggacagacagcgaccatcacctgttctggagacagattgactgaataaatntgctggctggtactcggcagaacgccgaggtcccacgtccccttgtgttggtcatctatcaggactaccgaacgccggtaccctcgacggaccttcccgngacgtctacttcctcgtcgcctaccgtaaccgtcgaacggtaaccacaccgcctacgtcgacgaccanaccgacggccggtactcgacgtacgtacgtcgagtacggacgtacgtacgttaacgttacgttacgtacggtacggacgggtcggtacgggaccgtaacgacccggtacggtacgggttacgggggttaccggtaccgggggacggggaaaccgggaaccgtaacggtaccggttaaccgggtacccgttaccggtacggaaccgtacccgaaccggacccgtaccggg

SEQ ID NO: 345633 - DNA, 668 bp, Homo sapiens
  misc_feature: GZ8MTXP02IYHDK.51.47.E03.1.454.CMB.2.raw
  modified_base (222)..(222): a, c, t, g, unknown or other
  misc_feature (222)..(222): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgcccacctcagtcgtccgtcgtccccaggacagacagcgaccatcacctgttcnggagacagtattgactagaataaatagtgctggctaggtacgtcggacaagaacgccgaggcccacgttcccctggttcgttggtctattctatacgaaggtactaaccgaacggccgtccctaggaggtaccctcccgagacgcgttacttcgtcgtcggtcctaaccgaacgtttcgaacgggaaccaacgtacgaccctactacggtacaaccacggttccgaaacgggccccgggtaacgtacggtacgtacgtaacgtacgtacgtacggacgtacgtaacgttacgttaacgttacgtacggtacggaacgggtcggaccggaacgaccggtaccgtacggtacgggttacggggttaacggtaccgggaacggggaccggaaccgtacggtaccggtaacgtaccgtacgtacggaccgtaccggacgacccggtacgg

SEQ ID NO: 345634 - DNA, 584 bp, Homo sapiens
  misc_feature: GZ8MTXP02HO85X.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
  modified_base (462)..(462): a, c, t, g, unknown or other
  misc_feature (462)..(462): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcngganacagattgactgaataaatatgctggctaggtatcggcagaacgccaggcccagtcccctgtgttgcatctatcagactaccagcgccctgaggtaccnccccgtgacgtcgtattccgtcgtggccttaccaaacttccgtagggaaaccacgaccncctaactcgtacgaccatccgagccgggaactcgaggacctagtcgatggacggtctagaccttagttacgagttaccggnggtacggacggaccgaccggtccgtacggtacgggttggggttaccggtcggggacgggaacggaccgtaacggtccgtaaccggtaccggtcgtacggacgtccgaccggtacccgaacgg

SEQ ID NO: 345635 - DNA, 605 bp, Homo sapiens
  misc_feature: GZ8MTXP02ITOIE.51.47.E03.1.454.CMB.2.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttcnggagacagattgactgataaatatgctggctggtatcggcagagccagccagtccccngtgtgtcatctatcaggataccaagcgcctcgaggctccctgagcgattctactggctccaactccgtagggaacacgacgccactctgaccatcaggcgggtactcgacggtctataccgagttaggacgggtctacgtaacgtttaacgttaacgttcggtacgtaaaggggtccgggttagggggaaccgaacggccccgggtaaccgtacccggggtttagggggttaccgtttaccgggggaccggggaacgggggtaaacccgaaacggtccgtaacggtaccccggtcgtacggacgtccgaaccgaccccgtaaaccggg

SEQ ID NO: 345636 - DNA, 635 bp, Homo sapiens
  misc_feature: GZ8MTXP02JZOG7.51.47.E03.1.454.CMB.2.raw
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggactaccaagcgccctcgacgggactcccgtaggactcggtatttccgtcgtcgggaccttacccgaaacttccgtacggggaaaaccacgaaccgaccctaaccgtacccgtacgaacccagttacccgaggtccggggaacctcgacggtcttaaacggccgtagtaggaggccgttacgtaacttagttaccgttaggttccgaacggggtcccggttagggggaacccgacggtccccgacggtaaccgggtgggggttaaacgttccgggggacggaacggggacccgaaggtcgtacggtacccgtcgtacggacgtccgacgtaccccgg

SEQ ID NO: 345637 - DNA, 611 bp, Homo sapiens
  misc_feature: GZ8MTXP02JPJCQ.51.47.E03.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgtcngganacagattgactagaataaatatgctggctggtactcggacaggaacgccgaacggcccacgttccccttggttggttcggtactattctatacgaggtactacccgaaggccggacctgaccgggtactcccgtagacgtcgtacttcctcggtcgcctaccgtacctacgtacgggaaactcgaacgccctaacgtctacgacctacgtacgaggccggactcgacggcttagcgtagtcggagtctaggacttaacgttcgnggtccgtaggtcggtacgggacncgggaccgtcgtacgggttacggggtacgttacgggggacggtaaccggaccgtaacggccgtcggtaacccgtcgtacggactaccggaccgtaacccgg

SEQ ID NO: 345638 - DNA, 617 bp, Homo sapiens
  misc_feature: GZ8MTXP02GLX75.51.47.E03.1.454.CMB.2.raw
  modified_base (224)..(224): a, c, t, g, unknown or other
  misc_feature (224)..(224): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcacgcccaccctcagtcgtccgtcgtccccaggacagacagcgaccatcaccttgttcnggagacagtattgactagaataaatatgctggctggtactcggacagaacgccacggcctacgtcccctggtgttcggtcatctatacgaaggactaccgaacgccgccctaggacggtaccctcccgtagacgtccgtacttccgtacgtcgggtaccctaccgtaacgtccgtacggaaacacgacgcccactctacgaccagtcgacggtccggactacgagcctagtacgagtcggacggtctaacgtacttaacgttccgtaggtacgacggggtcggtacggacgtcggacccgtagtacggggttagggtaccggtacggggaccggaacggaccacggtccgaaccggtacccgtacgtacgacgtaccgaccggacccgtacgg

SEQ ID NO: 345639 - DNA, 632 bp, Homo sapiens
  misc_feature: GZ8MTXP02GYSFK.51.47.E03.1.454.CMB.2.raw
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtcgtccgtcgtccccaggacagacagcacatcactgtcngganacagattgactgaataaatatgctggctggtactcggacagaacgccgacggcccacgtcccctggttcgtgtcatctatcgaggactaaccgaacggccggtaccctcggacgggtaccctcccgtagacgtcgtattccgtcgtcggtcctaccgtaaacgtcgtacgggaacacgaccgacctactcgacgaccatccgacggccggactacggacggtactacgtacgagttacggacgtctaggtaaccttagttaccgtacggtacggacgggtcgggtacgggaacgccggacccggtacgttacggggttagggggttaccgtacgggggaccgggtaacggggaacctaacggtccgtaacggtcccgtacggtacgaccgtaccgaccggtaccgacccgg

SEQ ID NO: 345640 - DNA, 607 bp, Homo sapiens
  misc_feature: GZ8MTXP02I1WFX.51.47.E03.1.454.CMB.2.raw
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (366)..(366): a, c, t, g, unknown or other
  misc_feature (366)..(366): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctnagtcgtccgtcgtccccaggacagacagcgaccatccacctgttcngganacagattgactgaataaatatgcgtggcgtggtatcggacaagaacgccgaggccctacgtcccctggttcgttggactagtctaagtcaaggtactaccgaacgccgtccctaggacggcctccctgacgtcgtattcncgtgacctacaacgtcgtagggaaccactacgccactacgtacgaccatcgacggaccgggactcgacggtactacgtacgacgtaggtacggacttacgtaacgttacgttacgtacgtacggacggggtcggttacgggacaccggcccggtacgacggttcggggtaacgtcggggacgggacggaaccgagcgtaaccgcccggttacgacggacgtacccgacggacccgtaacgg

SEQ ID NO: 345641 - DNA, 555 bp, Homo sapiens
  misc_feature: GZ8MTXP02HJK9H.51.47.E03.1.454.CMB.2.raw
  modified_base (243)..(243): a, c, t, g, unknown or other
  misc_feature (243)..(243): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagcccaccctcagtcgtccgtgtccccaggacagacagcaccatcacctgttctggagacagattgactgaataatntgcgtgctgtagcgacagacgcgacgccgtacgtccgtgtcgttgtactatctagtacgaagactaccgacgccgaccgtacgacggtccctccgtgacgtcgtacttcgtcgtcgtcctacacgtcgacggacacacgccactcacacagacgacggcgtactcgacgtctacgagtagtaggacgtacgtagtaacttacgttacgtcgtacggacggtcggtacggacgacgcgtacggtaggtcggggtacgcgggacgggacggacacggtcgtaaccggcgtacgacgtacgacgacgaccggacg

SEQ ID NO: 345642 - DNA, 576 bp, Homo sapiens
  misc_feature: GZ8MTXP02GBRV4.51.47.E03.1.454.CMB.2.raw
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
tcagcgatcgtatacacgaccggtgctcgatttagactcgcgcacagagagaaggggctgggcctcaggaagcagcattggaggtgcctcagccatggcatggatccctctcttcctcggcgtccttgcttactgcacaggatccgtggcctcctatgaactgactcagccaccctcagtcgtccgtgtccccaggacagacagcgaccatcacctgttctggagacagattgactgaataaatatgctggctggtatcggnagaagccaggccagtcccctgtgttggtcatctatcaggataccaagccgcccgtnacgggactcccgtgacgcgacttctcgtcgcctacctaactcgtacgggaaacacgacgaccctaactctacgacccatacgacgcggggacctcgaacggcttaagccgtaagtgggaaggtctaggtacttaacttacgtgtacgagggtcggtagggacacggccgacgtacggtacgggggttaacgttccggggacggggaacgggacgaaacgcgtacggacccgttcggtacgtacgacgaccgaacccgg

SEQ ID NO: 345643 - DNA, 651 bp, Homo sapiens
  misc_feature: GZ8MTXP02JK8EN.51.47.E03.1.454.CMB.2.raw
  modified_base (175)..(175): a, c, t, g, unknown or other
  misc_feature (175)..(175): n is a, c, g, or t
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (518)..(518): a, c, t, g, unknown or other
  misc_feature (518)..(518): n is a, c, g, or t
tcagcgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtgcctctatgaactgactcagccaccctnagtgtccgtgtccccaggacagacagcgaccagtccaccgttgtctagganacaggtattcgacttagaattaaaatgtgctggctggtatcggcaaggacgcgacggccacgtcccgtgtgtggtccntctatcgaaggtactaccgaagccgcctacgaccggtactcccgtnacggtcgtacttcctcgtcggtacctacccgtaaacgtccgtaacggggtaaaccacgtacgaccctacgtcccgtaacgtaccacgtaccgacgggccggtaacctaccgtagggccttacggtaccgaagttacggacgtaccgtacgacttaataccgtgtacgnggtacgtacggacgcggaccggtacgtacggtcggggttaccgttacggggaccggggtaaacgggtccctaaacggggtcctacgggtaaaccccgttccggtaggtaccggtaaccgacccggtaaccccg

SEQ ID NO: 345644 - DNA, 639 bp, Homo sapiens
  misc_feature: GZ8MTXP02FV69Q.51.47.E03.1.454.CMB.2.raw
  modified_base (109)..(109): a, c, t, g, unknown or other
  misc_feature (109)..(109): n is a, c, g, or t
  modified_base (224)..(224): a, c, t, g, unknown or other
  misc_feature (224)..(224): n is a, c, g, or t
tcagcgatcgtatacacgaccggtgctcgatttagactcgcgcacagagagaaggggtgggcctcaggaagcagcatcggaggtgcctcagccatggcatggatccctntcttcctcggcgtccttgcttactgcacaggatccgtggcctcctatgaactgactcagccaccctcagtgtccgtgtccccaggacagaccagcgaccatcacctgttctgganacagattgactgataaatatgctggctggtatcggcagagccaggccagtcccctgtgttggtcatctatcaggactaccgaagccgccctcgagggacctcccgtgacgtcgtatcctctggcctaccaactccgtagggaacacagacccacgtctacgaacccataccgaggaccgggactcgaacggtctatcgataggacggtcctagtacccgtattacccgtggttaccgacgggtacggtacggggaaccacgggccccgtacgtaacccgggttagggggttaaccgttaccgggggaaccgggtaacgggggtaaaacccaaacggggtacccttaacggggaacccccggtttaccgtaacgggtacccggttacccgaaccgggtacccccgtaaaaccgggg

SEQ ID NO: 345645 - DNA, 529 bp, Homo sapiens
  misc_feature: GZ8MTXP02GDD7X.51.47.E03.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagcgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcaaccaccctcagtgtccgtgtccccaggacagacagcgaccatcacctgttctgganacagattgactgataaatntgctggctggtancggcagagccaggccagtccctgtgttggcagtctatcaggataccgaagccgcctgacgggactcccccgtagacgcgattctcgtggcctaccactcgtaggggaacacgtacgcacttcacgacatcgaacgcggtactcgacggctagtcgaatgagcgtanactattcgngtacgaggtcgtaggacngccgcgtacgtacggggtntccgggaggacggtaccgaacgtcgtacggccgtcgtagaccgtcgacgtcccgaagtcccg

SEQ ID NO: 345646 - DNA, 526 bp, Homo sapiens
  misc_feature: GZ8MTXP01BH4R1.52.6.A06.1.454.CMB.2.raw
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
tcagcgcagtacgacacgaccggtgctcgatttagatctactgacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgaggtcagtgatcggcccgcgaggggtttctcatcgcttctccggcctccaagtctggcaagcncggcctccctgaccatctctgggctcaggctgaggacgaggctgattatactgcagctcattanacaagcaagaaacacgttgggtgttcggcgggcgggaaccaaacgttcgaaccgttccgtacgtcacgcccaaggctcgcccctggcactcttcgttcccc

SEQ ID NO: 345647 - DNA, 531 bp, Homo sapiens
  misc_feature: GZ8MTXP01BKQN7.52.6.A06.1.454.CMB.2.raw
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagcgcagtacgacacgaccggtgctcgatttagatctactgacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcaccggaacagcaatgactattggtacttataattctgtctcctggtaccaacaactaccccggcaaacgtcccaaactcatgatctttgaggtcagtgatcggccgngtagggtttctcatcgcttcgtccggcctccaagtctggcaagccncggccctcccgtgacctatctcgtgggctccgagctgaggacgaggctgattatactgcagctnatanacaagcaagaaactacgtggtgtcggcggcgggaacctaaagcgaccgttcgtacgtcacgcccgaacggcctcgccccttcggcttactccttcgttccccc

SEQ ID NO: 345648 - DNA, 535 bp, Homo sapiens
  misc_feature: GZ8MTXP01EG7BD.52.6.A06.1.454.CMB.2.raw
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
  modified_base (425)..(428): a, c, t, g, unknown or other
  misc_feature (425)..(428): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaaacaataccccggacaaaacgtccccaaaactcactgatctttgaggtcagtnatcgccngagggtttctcatcgcttcnccggcctccaagtctggcaagccaacggccctccctgaccccatctctcgggctccgaggctaggagacgaggctgattatacnnnnctnatanananananaatagtgtgtcggcggacggaacgaacgacgaccgttaccgtacgtcacgccgacgccgtccgtcccgtccgtccttactccgttccgtccc

SEQ ID NO: 345649 - DNA, 568 bp, Homo sapiens
  misc_feature: GZ8MTXP01DECSD.52.6.A06.1.454.CMB.2.raw
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
tcagcgcagtacgacacgaccggtgctcgatttagatctactgacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacggaaccagcaatgacattggtacttataattctagtctcctggtaccaacaataccccggcaaacgtcccaaaactcatgatctttgagtcagtgatcggccgcaggggtttcncgatcgcttcnccggctccaagtctggcaagtcncggcctccctgaccatcnctggctccaggctgagtacgaggctgattattacgngacagctacaatacacgaacgtacgaacgtaaacgtacggttcgggtacggtcggaccgggaacggtaacctaaacgttcggtaacccgttaccgtaacgtcacgccgaacggtcctcccgtccccgttcggtccttaccttccgttccgttcccc

SEQ ID NO: 345650 - DNA, 530 bp, Homo sapiens
  misc_feature: GZ8MTXP01AI2ZZ.52.6.A06.1.454.CMB.2.raw
  modified_base (505)..(505): a, c, t, g, unknown or other
  misc_feature (505)..(505): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgctagggggtttctcatcgcttcctccggctccaagtctggcaagcacggcctccctgaccatctctgggctcgaggctgaggacgaggctgattatactgcagctcatactacaagcagaactacttgggtcgttcggcggtcgggaccaaacgttcgaccgtcttacgttcacgcccaaggtcnccgccccttcggtccaacgttcccg

SEQ ID NO: 345651 - DNA, 524 bp, Homo sapiens
  misc_feature: GZ8MTXP01CTZ3B.52.6.A06.1.454.CMB.2.raw
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
tcagcgcagtacgacacgaccggtgctcgatttagatctactgacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacggaaccagcaatgacattggtacttataattctgtctcctggtaccaacaataccccggcaaacgtccccaaactcatgatctttgaggtcagtgatcggccgcaggggtttcncatcgcttctccggctccaagtctgcaagcncggcctccctgaccatctcgtgggctccgaggctgaggacgaggctgattattactgcagctcatataacaagcaagaaacacgttgggtgttcgggcggtcgggaacaaacgttcgaccgttcgtaacgtcacgccaaggctcgcccctcggtcactcttcgtcccc

SEQ ID NO: 345652 - DNA, 536 bp, Homo sapiens
  misc_feature: GZ8MTXP01C0BXK.52.6.A06.1.454.CMB.2.raw
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacagcaatgacattggtacttataattctgtctcctggtaccaacaataccccggacaaacgtaccccaaactcatgtatctttgaggtcagtgactcggcccgcgtagggggtttcncatcgcttctccggcctccagtctggcaagcncggcctccctgaccatctcgtgggctcgaggctgaggacgaggtctagtattatactgacagctcatataacgaagcaagaaactacgttgggtcgttcgggcggcggaaccaacgttcgaccgttcgtacgtcacgccagctcgcccctggtcacgtcttcgttcccc

SEQ ID NO: 345653 - DNA, 541 bp, Homo sapiens
  misc_feature: GZ8MTXP01C0MBH.52.6.A06.1.454.CMB.2.raw
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (421)..(421): a, c, t, g, unknown or other
  misc_feature (421)..(421): n is a, c, g, or t
  modified_base (425)..(426): a, c, t, g, unknown or other
  misc_feature (425)..(426): n is a, c, g, or t
  modified_base (434)..(434): a, c, t, g, unknown or other
  misc_feature (434)..(434): n is a, c, g, or t
tcagcgcagtacgacacgaccggtgctcgatttagatctactgacgaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccggaacagcaatgacattggtacttataattctgtctctggtaccaacaataccccggcaaagtccccaaaatcactgatctttgaggtcagtgatcggccgcgtagggtttcncatcgcttctccggccttccaagtctggcaagcncggccctcctcgaccatctcgtcgggctccgaggctgaggacgaggctagacttatacgngacnnctatatanacgaagacaagtaacgtggttcggtcggtacggacggacggaacctaacgcgtaccgttcacgtcacgccgacgtcctccgcccgtcgccttactccgttccgtccc

SEQ ID NO: 345654 - DNA, 579 bp, Homo sapiens
  misc_feature: GZ8MTXP01C4CDZ.52.6.A06.1.454.CMB.2.raw
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcaccggaaccagcaatgactattgtacttataattctgtctctagtaccaacaacacccggacaaacgtcccaaactcatgattctttagagtcagtgacgtccggccgcgtaggggtttcactattccgtcttcgtccggtccctaccgtaagtcgtcggcaacgccaaccggtccctccctacgacctactctcggtcgggccttaccgaggctaggacggacgagtctagtattattacngacnctctacaatanaacgaacgacgaacgtaacgtacggttggtcggtacgggacggacggaactaacgttcgtaccgttcgtacgcacgccgacgcctccgcccgtcgtcttctccgttccgtccc

SEQ ID NO: 345655 - DNA, 575 bp, Homo sapiens
  misc_feature: GZ8MTXP01C5SMW.52.6.A06.1.454.CMB.2.raw
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (430)..(430): a, c, t, g, unknown or other
  misc_feature (430)..(430): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccggaacagcaatgacattggtacttataattctgtctcctggtaaccaacaactaccccggacaaacgtccccaaactcatgattctttgagtcagtgactcggccgcgtagggtttcncatcgcttcnccggtcctcagtctggcaacgccncggccctccctgaccatctctcgggcctccgaggctaggacggacgaggctagatttacttacgngacatactactaatacaacgaagacaacgtaacgtcggttcgggtcgtccgggacggaccggaactaacgttcgtacccgttcgtacgtcgaccgccgacgtccgtcccgtccccgtcgtccttaccttcccgttcccgtccccg

SEQ ID NO: 345656 - DNA, 543 bp, Homo sapiens
  misc_feature: GZ8MTXP01DIXB0.52.6.A06.1.454.CMB.2.raw
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggccagtctgccctgactcagcctgcctccgtgtctgggtctcctggacagtcgatcaccatctcctgcaccgaaccagcaatgacattggtacttataatctgtctcctggtaccaacaataccccggcaaagtccccaaactcntgatctttgagtcagtgatcggcccgnaggggtttctcatcgcctttcctccgggctcctaagtcgtgggcaagccaaccggccctccctgacccatctctggactccagctgagcgagctgattntactngacgctcatanacagcaaacgaactacgttgggtcgttccgggaacggcgggttaacccaaacgttcgaccgtccttacggttcacgaaccctagggctccnccccgttcgtaacncgttcc

SEQ ID NO: 345657 - DNA, 688 bp, Homo sapiens
  misc_feature: GZ8MTXP01EOIUY.52.6.A06.1.454.CMB.2.raw
  modified_base (216)..(216): a, c, t, g, unknown or other
  misc_feature (216)..(216): n is a, c, g, or t
  modified_base (268)..(268): a, c, t, g, unknown or other
  misc_feature (268)..(268): n is a, c, g, or t
  modified_base (299)..(299): a, c, t, g, unknown or other
  misc_feature (299)..(299): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcacgaaccngcaatgacattggtacttataattctgtctctgtaccaacaactaccccggnaaagtcccaaatcatgatctttgagtcagtnacgtcggccgtgtacgggtttctctagtcgtcttccgtccggccctaccgtaacgtctcggacaacgccgaaccgggtccctcccgtcgaaccctattccgtcggtcgggtacccttaccgagggtccgaggacggacggaacggtcttagttaaattacttaccgtgacgtacgtacgttaactaaattaacgaaacgaaagtaaccgtaaacggttaaaccggttacgggtttcggggttaccgggttaccggggaccggggtaaccggtaaacccgtaacgttcccggtaacccgttaccgtaaccggtaccgaccggacccgttacggtcccgtccccgtccccgttccggtacccttacccgtttccgttaaccccgttccccg

SEQ ID NO: 345658 - DNA, 618 bp, Homo sapiens
  misc_feature: GZ8MTXP01ETMA9.52.6.A06.1.454.CMB.2.raw
  modified_base (371)..(371): a, c, t, g, unknown or other
  misc_feature (371)..(371): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcaccggaaccagcaatgactattggtacttataattctgtctcctggtaccaacaactaccccggacaaacgtccccaaactcatgatctttgaggtcagtgagtcggcccgcgagggggtttctcatcgtcttctccggtcctcctagtcgtggcaagccnccggccctccctcgacctactctcgtcgggcctcaggctggaggacgaggctagtattattactgcagctactatataacaagacaacgtaaactacggttcggggtcggtttccgggaccgggtaccgggaaccctaaaacgttcggtaccccgttaccgtaccggtccgaccggccccgaaacggtccccgtcccgtcccccgttccgggtacccttacccgttcccgttccggtttcccccccg

SEQ ID NO: 345659 - DNA, 755 bp, Homo sapiens
  misc_feature: GZ8MTXP01AOVHF.52.6.A06.1.454.CMB.2.raw
  modified_base (219)..(219): a, c, t, g, unknown or other
  misc_feature (219)..(219): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccggaacngcaatgactattgtacttatattctgtctctgtaccaacaactaccccggacaaacgtaccccaaactcatgaattctttgaggtcagtgagtccggccgtcgtagggggtttctcgtacttcgtcttccgtccggtccctaccgaaagtcgtcggccaaacgccgaaccggtccctcccgtacgaccctattccgtcgtcgggcctaccgtagggcttcgggaacggacggaaggtccgttaggtaatttaacgttacgtcgtacgtaacggccgttaacgtaagtttaactaaacgaaacgaaccgtaaacggtaaaaccgtttacgggtttacgggggtttaccggggtttaccgggggacccggggttaacccgggaaacccgtaaaacccggttacggggtaaaccccgttacccggttaaaccgttacccgaacccgggccccgttaaaacgggtccccgttacccgggtcccccccgttacggggttacccttacccggtttcccgtttccccgggttttccccccccg

SEQ ID NO: 345660 - DNA, 516 bp, Homo sapiens
  misc_feature: GZ8MTXP01CEPT1.52.6.A06.1.454.CMB.2.raw
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
  modified_base (419)..(419): a, c, t, g, unknown or other
  misc_feature (419)..(419): n is a, c, g, or t
  modified_base (510)..(510): a, c, t, g, unknown or other
  misc_feature (510)..(510): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccgaccagcaatgacattggtacttataattctgtctcctggtaccaacaataccccggacaaacgtccccaaactcatgatctttgagtcagtgatcggcccgcagggggtttcncatcgcttcctccggctccaagtctgcngcacggccctcctgaccatctctgggctcaggctgaggacgagctgattatactgcagctnatatacaagcaagaaactacgttgggtgttcgggcggacgggaccaaacgttcgaccgtcacgttcacgccaagcctcgccccttggtccncgttcc

SEQ ID NO: 345661 - DNA, 531 bp, Homo sapiens
  misc_feature: GZ8MTXP01D7NQN.52.6.A06.1.454.CMB.2.raw
  modified_base (192)..(192): a, c, t, g, unknown or other
  misc_feature (192)..(192): n is a, c, g, or t
  modified_base (366)..(366): a, c, t, g, unknown or other
  misc_feature (366)..(366): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatctctgcaccggacagcaatgacattggtacttataattctgtctcctggtaccaacaactaccccggacaaacgtccccaaactcatgatctttgaggtcagtgactcggccgcgtacgggggtttctcattcgcttcctccggcctccaagtctgcaacgcnccggcctccctcgaccatctcgtcgggctcgaggctgagacgaggctgattatactgacagctcatatacaagcaagaaactgttggtgttcggcggcggaaccaacgttcgaccgttcgtacgtcacgccaaggctccgccctcggtcacgtcttccgttcccc

SEQ ID NO: 345662 - DNA, 595 bp, Homo sapiens
  misc_feature: GZ8MTXP01D4U9W.52.6.A06.1.454.CMB.2.raw
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccgacagcaatgacattggtacttataattctgtctcctggtacaacaactaccccggacaaacgtccccaaactcatgtatctttgagtcagtgatcggccgngtaggggtttcnctatcgcttctccggcctccaagtctgcaacgcnccggcctccctgaccctatctcgtcgggctcgaggtcnggaggacgaggctgtattattacgngacntctataataacaacgaagacgtaaacgtaaacgttacggttcgggtcggtcgggaccgggaccggtaaaccgtaacgttcggtaccgttaccgtacgtacgaccggaccgttaccggtcccgtcccggtccccgtcgtaccttaccgttccgttcccgttaacccc

SEQ ID NO: 345663 - DNA, 752 bp, Homo sapiens
  misc_feature: GZ8MTXP01ARISG.52.6.A06.1.454.CMB.2.raw
  modified_base (327)..(327): a, c, t, g, unknown or other
  misc_feature (327)..(327): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcacatctctgcacgacagcaatgactattgtacttatattctgtctctgtaccaacaactacccgacaaacgtacccaaatcatgacttcgtttggagtcagtgtacgtccgggccgtcgtaggggttttcncgtacttccgtcctttccgtcccggacccttacccgtaagtccgtacggcaaaccggcccgaacccgggtccctaaccccgtcggaacccctagttcccgtcgtcggggtaccctccgacgggtaccttaggggaaccggaccggtaagggtccttagggttaactttaacgttacgtcgaccgtagccgtttaaccgtaaagtttaaactaaacccgtaaaggaacctaaacggttaaaaaccggttcccggggttttagggggtaacccgggttcggggaacccggggtaacccggggtaaaccctaaaacggttccggtaaccccgttacccgtaacggttacccgaccgttacccggaaccggtccgtttccccgcccccggttcgggtacccttaccgttcccgtttcccggttcccccg

SEQ ID NO: 345664 - DNA, 661 bp, Homo sapiens
  misc_feature: GZ8MTXP01DO07J.52.6.A06.1.454.CMB.2.raw
  modified_base (217)..(217): a, c, t, g, unknown or other
  misc_feature (217)..(217): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgaacngcaatgacattgtacttatatctgtctctagtacaacaactacccgacaaacgtacccaaactcatgtatcgtttgagtcagtgacgtccggcccgcgtaggggtttctacgtagttccgtccttccgtccgtccctaccgtaaagttccgtcgggaccaacgcccgtaacccgggtccccttaccccgtcggtaaccctacgttccgtccgggtcgggtcccttacccgaagggtccgttagggaacgggaacggtacgggtcttaggttaactttactacgtgctaacgtctactaattaacacgaaagaccaaagaaactcggttcgggtacggtcgggacggacggaaacaaacggttcgtaccgttccgtacgtacgacgcccgaacggtcccgtccgtccccgttacggtccttacccgttccgttcccgttcccccg

SEQ ID NO: 345665 - DNA, 559 bp, Homo sapiens
  misc_feature: GZ8MTXP01CGVA3.52.6.A06.1.454.CMB.2.raw
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (527)..(527): a, c, t, g, unknown or other
  misc_feature (527)..(527): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccgaacagcaatgacattggtacttataattctgtctcctggtaaccaacaactaccccggacaaacgtccccaaactcatgatctttgaggtcagtgatcggcccgcgtagggtttcncgatcgcttctccggcctccagtcnggcaacgcnccggccctccctagacccatcgtctcgggcctccgaggcnggaggacgaggtctgattattacgngacanctatataanaacgaaagacaagtaacgtggttggtcggtacggacggaccggtaaccaacgttcgtaccgttcgtacgcgacgccgacgtccnccgtccccgtcgtccttactccgttccgtccc

SEQ ID NO: 345666 - DNA, 746 bp, Homo sapiens
  misc_feature: GZ8MTXP01B9JIP.52.6.A06.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacngcaatgacnttgtacttatatctgtctctgtaccaacaactacccggcaaacgtcccaaactcatgaattcttgaggtcagtgacgttcggcccgtcgtacgggggtttctcagtccgtcctttcccgcccggtctcccgtaaacgtccgttcgggccgtaacggcccgaacccggggtcccttccccgtacggtaccccacttccctccgttacggggtccttacccggaaggtcccgttaggaacggggaccggagggtaccgtaggtaagtttaacttaacgtcgggttacccggaagtcccgttactaacgtttaaaacgtaaaccgaaacgtaacgtaaacggtaaaccggttacgggtttacggggttaccgggttccggggtaacccggggtaaccgggttaaacccgtaaaccggttacccggtaaacccggttcccgttaaccggttccgaccggtaaccccggacggtcccgtaccccggtccccgttaccggttaaccgttcccgtttcccg

SEQ ID NO: 345667 - DNA, 558 bp, Homo sapiens
  misc_feature: GZ8MTXP01B2V8U.52.6.A06.1.454.CMB.2.raw
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (358)..(358): a, c, t, g, unknown or other
  misc_feature (358)..(358): n is a, c, g, or t
  modified_base (421)..(421): a, c, t, g, unknown or other
  misc_feature (421)..(421): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttatattctgtctcctggtaccaacaactaccccggcaaacgtccccaaactcatgatctttgagtcagtgatcggccgntagggtttcncatcgcttctccggcctcagtctggcaagcncggcctcccgtgaccatctctcgggcctcgaggctggacggagaggctgtattattactgacngctcattactaacaagcaaacgtaaactacggttgggtcggttcgggccggtacgggaaccaaacgttgacccgttcgtacgtcttacggcccaacggcctccgccccgtcggtccacttccgttcgtttaaccccc

SEQ ID NO: 345668 - DNA, 543 bp, Homo sapiens
  misc_feature: GZ8MTXP01AUAZS.52.6.A06.1.454.CMB.2.raw
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
  modified_base (423)..(423): a, c, t, g, unknown or other
  misc_feature (423)..(423): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcacgacagcaatgacattgtacttatattctgtctctggtaccaacaactaccccggacaaacgtaccccaaactcatgatcttgagtcagtgatcggcccgngtacgggtttctcatcgcttcgtccggcctccaagtctggcaacgccncggcctccctgacccatctcgcgggcctccgaggcctggacggacgaggctaggtattacttacngcagctacaattataacaagacaagtaaactacgttgggtgttcggcggacggaacaaacgttcgaccgttctacgtcacgccacggctccgcccgtacgtccttactccgttcgtcccc

SEQ ID NO: 345669 - DNA, 765 bp, Homo sapiens
  misc_feature: GZ8MTXP01AWLKB.52.6.A06.1.454.CMB.2.raw
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcacggaccagcaatgactattgtacttatattctgtctctgtacaacaactaccccgacaacgcccaaatcatgatctttgagtcagtgagtcggccgtcgtaggggtttctcgtatccgtcttccgtcccggtccctaccgtaagttccgtcggccgaaacgcccgaacccgggtccccttaccccgttacggaacccctacgttcccttcgttccgggggtcccttacccggaagggtcccgtagggaacgggaccggtacggggtccttagggtaactttaacttaaccgtcgacccgtagtccgttaacgtaattaaactaaccgaaacggacaaacggtaaaaccgttaccgggttgggggttaccggttccggggaccggggacccgggggtaaaacccctaaacggttcccgggtaaaccccggttaccccggttaaaccggttacccgaacccggttaccccggaaaccgggttcccgttccccggtaacccccccggtttccggggtacccttaaaccccgttcccgtttccccggtttaacccccccc

SEQ ID NO: 345670 - DNA, 493 bp, Homo sapiens
  misc_feature: GZ8MTXP01DCXKH.52.6.A06.1.454.CMB.2.raw
  modified_base (320)..(320): a, c, t, g, unknown or other
  misc_feature (320)..(320): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (397)..(398): a, c, t, g, unknown or other
  misc_feature (397)..(398): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgacagcaatgacattgtacttatattctgtctctggtaccaacaactaccccggcaaacgtccccaaactcatgatcttgagtcagtgatcgccgcagggtttcncatcgcttcctccggctccaagtctggcngcacggcctcctgacntctctggctcgagctgagacgngntntatatnncgntctanatanacanacaanacgtgtggtcgtcggcggacgactacgcgaccgtcacgcacgccgacgtcctccgtcccttcgtccgttcgtcg

SEQ ID NO: 345671 - DNA, 681 bp, Homo sapiens
  misc_feature: GZ8MTXP01BIAUP.52.6.A06.1.454.CMB.2.raw
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttatattctgtctctgtaccaacaactaccccggacaaacgtcccaaactcatgatcgtttgagtcagtgagtccggcccgcgtacggggtttctctacttcgcttcgtccggccctacccgtaagtcgtcggcaaacgccctaaccgggccctccctagacccctacttctcgtcgggtccttaccgacggtcgtacggaacgggacggtagggtaccttaggtaacttttaacttacgtcggtactaacggtcttaacgtaattaactaaaccgaaacggaccaaacggtaaaaccttaaccgggtttggggtacggttaccgggggaccgggaacggggaaaccctaaaccgttcgggaacccgttaccgtaccggtaccacggttcccgaacggtcctaccgtccccgtacggtcaccttccgttcccggtttaaccccc

SEQ ID NO: 345672 - DNA, 549 bp, Homo sapiens
  misc_feature: GZ8MTXP01EVG1G.52.6.A06.1.454.CMB.2.raw
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtcccaaactcatgatcttgagtcagtgatcggcccgctaggggtttctcatcgcttctccggcctccaagtctggcaacgcaacggccctccctcgacctatctcgtgggcctcgaggctgaggacgaggctgattattactgcagctactataataccaagcaagaaactacgttgggtgttcggcggcgggaaccaaacttcggaacccgttccgtacgtcacgcccaagggcctcggcccctcggtccacctccgttcggttcccccg

SEQ ID NO: 345673 - DNA, 597 bp, Homo sapiens
  misc_feature: GZ8MTXP01BNQYO.52.6.A06.1.454.CMB.2.raw
  modified_base (330)..(330): a, c, t, g, unknown or other
  misc_feature (330)..(330): n is a, c, g, or t
  modified_base (380)..(380): a, c, t, g, unknown or other
  misc_feature (380)..(380): n is a, c, g, or t
tcagcgcagtacgacacgaccggtgctcgatttagatctactgacaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctggtaccaacaataccccggacaaacgtccccaaactcatgatcttgagtcagtgatcggcccgctagggggtttcnctactcgtcttccgtcccggctcaagtctgacagccgacggtccctcccncgacctatctcgtcgggcctccgaggctggaggacgagtctagtattactacgtgcaggtctactaattaacaacgaagacgaacgaaaacgtcgttaggggtcgttccggggcgggaaccgggtaaaccaaacgtccggaccgtaccgtacgttaccgcgacccgaaggggtccctaaccgtcccccgttcggttacctaaccttcgtttcccccg

SEQ ID NO: 345674 - DNA, 533 bp, Homo sapiens
  misc_feature: GZ8MTXP01DD5ZT.52.6.A06.1.454.CMB.2.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (378)..(378): a, c, t, g, unknown or other
  misc_feature (378)..(378): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagcgcagtacgacacgaccggtgctcgatttagatctactgacaggggcctgggaggtccctgagactctcctgtgcaggctctgcatttcccttcagtaactatgctatcgattgggtccgccaggctccaggcaagggactggagtgggtggcagttatatcagctgatggaggcaataagtattacgcagattctgcgagggccattcaccatanccagagacaactccaagatangatatatctagacaaatgaacagcctgagacctgaaggacacggccaatatattattgtgcgtcgagggggcaggtcgctcggccagtgatgtacttttgntttcgnggggacctaaagggctagttcgcaccgtcncctcacgcctaccaccgaacgggccctaagtccggtccttcccccgtgccctacccgtcctaccgaacgtacgccaccgtcgtcggggacacgtagccgccgtgggctcgctgcaacggtcttacgttcatccganccgngtcgagtcggcgcgg

SEQ ID NO: 345675 - DNA, 549 bp, Homo sapiens
  misc_feature: GZ8MTXP01EL5UC.52.6.A06.1.454.CMB.2.raw
  modified_base (272)..(272): a, c, t, g, unknown or other
  misc_feature (272)..(272): n is a, c, g, or t
  modified_base (317)..(317): a, c, t, g, unknown or other
  misc_feature (317)..(317): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (525)..(525): a, c, t, g, unknown or other
  misc_feature (525)..(525): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctgtaccaacaacaccccggnaaacgtccccaaatcatgatctttgaggtcagtgactcggcccgngtacgggtttcncatcgcttcgtccggcctccagtcgtggcaagcncggcctcctgaccntcncgtcgggctcgagctggacggacgaggctgtattatacgtgctagctactaattacaacgaagacaaacgtaaacgtacggtttgggtcggttacgggccgggacgggaaccaaacgttcgaccgttctacgcacgccaggtccncgccccgtgcactcgttcgtcccc

SEQ ID NO: 345676 - DNA, 584 bp, Homo sapiens
  misc_feature: GZ8MTXP01BMEQT.52.6.A06.1.454.CMB.2.raw
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacatctcngcacgaacagcaatgactattgtacttatattctgtctctgtacaacaactaccccggacaaacgtcccaaactcatgatctttgagtcagtgatcggccgcgtagggtttcncatcgtcttcgtccggctcagtctgcaacgcncggcctccncgacactctcgtcgggctaccgaggctaggacggacggaggtcttagtaattacttacgngacacgtctacaattaacaacgaaanacgaagaaactacggttgggtcggttcgggaccgggtacgggaaacctaaacgttcggtaaccttccgtaacgcgaccggacccgaacggtccgtcccgtccccgttcggtccttaccgttcccttccgttaaccccc

SEQ ID NO: 345677 - DNA, 667 bp, Homo sapiens
  misc_feature: GZ8MTXP01ACFP2.52.6.A06.1.454.CMB.2.raw
  modified_base (315)..(315): a, c, t, g, unknown or other
  misc_feature (315)..(315): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacagcaatgacattggtacttatattctgtctctggtaccaacaacaccccgacaacgtcccaaactcatgattctttgaggtcagtgatcggcccgngtaggggtttctcatcgtcttctccggctccagtctggcaagccncggcctccctgaccntctcgtgggcctcgaggctggacggacgagggcttaggtactttagttactcgacgaagtcgttacaatttaactaaaccgaaaagaccgaaacgtaaaaccggttaaccggtttgggggttcgggttaccgggacccgggggtaccgggggaaacccctaaaaccggttcgggaaaccccgtttcccgtaaccggttacccgaaccggcccccggaaacgggtcccgtacccgggtcccccccgtttacgggtccttaacccggttcccgtttcccggtttaacccccccc

SEQ ID NO: 345678 - DNA, 610 bp, Homo sapiens
  misc_feature: GZ8MTXP01EUFYF.52.6.A06.1.454.CMB.2.raw
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcaccggaacagcaatgacattggtacttatattctgtctcctgtacaacaactaccccggacaaacgtcccaaactcatgattcttgagtcagtgacgtccggccgcgtacgggtttctcgtattcgtcttccgtccggccctaccgtaagtcgtgcaacgccnccggccctcccncgacctagtctcgtcgggctcgaggcgtggacggacgaggtctagtattattacgtcgctacgtcgtactaattaactaacgaaacgtacgaaacgtaaacgttcggttggggttacggtccgggaccgggacggaaacctaaacgttcggacccgttaccgtacgtaccacgcccgttaacggcctacccgccccgtcgtaccttaccgtccttccgtaacccc

SEQ ID NO: 345679 - DNA, 545 bp, Homo sapiens
  misc_feature: GZ8MTXP01CRKEC.52.6.A06.1.454.CMB.2.raw
  modified_base (318)..(318): a, c, t, g, unknown or other
  misc_feature (318)..(318): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcaccggacagcaatgacattggtacttatattctgtctctgtacaacaactacccgacaacgtcccaactcatgatctttgaggtcagtgatcggccgtcgagggtttcncatcgcgttctccggtcctcctaagtctggctaacgcgccggccctccctcgaccatctcgtcgggctccgaggcgtggacggacgaggtctagtattattcgtagcaagctcgaatatacgagacgaagaactacgtggtgttcgggcggccgggaaccaaacgttggtacccgttcgtacgtcacgccgacgcncgccncccgtcggttcctcgttccgttcccg

SEQ ID NO: 345680 - DNA, 800 bp, Homo sapiens
  misc_feature: GZ8MTXP01B7YEU.52.6.A06.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccgacngcaatgacnttgtacttatattctgtctctggtaccaacaactaccccggacaaacgtccccaaactcatgatctttgaggtcagtgactcggcccgtcgtacggggtttctcacttcgtccttccgtccggtcccttaccgtaaaggttcctcgggccaaacggcccgtaacccggggtccccttcccgtacggacccctacgttcccgttcggtcgggggtcccttcccggaacggggtcccgttggggaacgggaacggtaacggggtcccttaagggtaacgttttaacttaacgttcgacgtaacggtccgttacgtaaacgttaactaaaccgaaaggaccctaaaaggtaaaaccgttaccgggtttgggggttaccgggtttaccgggggacccggggaacccgggggtaaaaccccgtaaaacggttcccgggtaaccccgttacccgttaaacccgggttcccgaaacccgggttacccccggaaacggggtccccgttaccccgggtaacccccccgtttcggggtaccccttacccggttccccgttttccccgggttttcccccccccgg

SEQ ID NO: 345681 - DNA, 543 bp, Homo sapiens
  misc_feature: GZ8MTXP01A1BMF.52.6.A06.1.454.CMB.2.raw
  modified_base (361)..(361): a, c, t, g, unknown or other
  misc_feature (361)..(361): n is a, c, g, or t
  modified_base (521)..(521): a, c, t, g, unknown or other
  misc_feature (521)..(521): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcaccggaacagcaatgacattggtacttatattctgtctctgtaccaacaataccccggcaaacgtcccaaactcatgatctttgaggtcagtgactcggcccgcgtagggggtttctcatcgcttccctccggctccaagtctcggcngcaccggcctccctgaccatctcgtcggctcgaggctggaggacgagctgtattatacgtgcgagctcatataacaagctaagaaacctagttggggtcgttcgggcgggcgggaaccaaacgcgaccgtcccttacgttccacgcccgaagccgttccnccccgttcgtccgaacttcccg

SEQ ID NO: 345682 - DNA, 542 bp, Homo sapiens
  misc_feature: GZ8MTXP01BYQB6.52.6.A06.1.454.CMB.2.raw
  modified_base (321)..(321): a, c, t, g, unknown or other
  misc_feature (321)..(321): n is a, c, g, or t
  modified_base (369)..(369): a, c, t, g, unknown or other
  misc_feature (369)..(369): n is a, c, g, or t
  modified_base (445)..(445): a, c, t, g, unknown or other
  misc_feature (445)..(445): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattgtacttataattctgtctctggtaccaacaactaccccggacaaacgtccccaaactccatgattctttgagtcagtgatcggcccgtnagggggtttctcatcgtcttctaccggtcctccaagtctggcaacgcncggccctccctgacctatctcgtgggctcaggctgacggacgagtctagattattactgcagctacatatacgaanccaagaactagtggtaggtcggtcggcggaaccaacgttcgaccgttctaacgtcagcccgaagtcctccgccctcggtcactccgttcgtaacccc

SEQ ID NO: 345683 - DNA, 533 bp, Homo sapiens
  misc_feature: GZ8MTXP01AES5R.52.6.A06.1.454.CMB.2.raw
  modified_base (317)..(317): a, c, t, g, unknown or other
  misc_feature (317)..(317): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (518)..(518): a, c, t, g, unknown or other
  misc_feature (518)..(518): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaactaccccggcaaacgtccccaaatcatgatctttgagtcagtgatcggccgngaggggtttctcatcgcttcgtccggcctccagtctcggcaagccncggcctccctgaccatctctcgggctccgaggtctggaggacgaggctgattattactgacngctcaattanaacaagcaaagaactacgtgggtgttcgggcggcggaacaaacgttgacccttcgtacgcacgccaggcctcgccccttggcnctcgttcgttccccg

SEQ ID NO: 345684 - DNA, 553 bp, Homo sapiens
  misc_feature: GZ8MTXP01A26W6.52.6.A06.1.454.CMB.2.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcaccggaacagcaatgacattgtacttataattctgtctctgtaccaacaactaccccganaaacgtcccaaatcatnatctttgagtcagtgatcggccgcgtagggtttcncatcgcttcgccgcctcagtcnggcaagcncggcctccctgaccatctcgtcgggcctcacggctaggaggacgaggtctagtattatactgcagctactaatataaccaaagcaagtaaaccgtaggttggtacggtcgggaccggacgggaaacctaaacgttcgaccgttccttacggcacgcccgaagtccgccgtcccctcggtccttacctcggttccgttccccg

SEQ ID NO: 345685 - DNA, 638 bp, Homo sapiens
  misc_feature: GZ8MTXP01BD6QN.52.6.A06.1.454.CMB.2.raw
  modified_base (374)..(374): a, c, t, g, unknown or other
  misc_feature (374)..(374): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcaccggaacagcaatgacattgtacttataattctgtctctggtaccaacaataccccggacaaacgtccccaaactcatgatctttgaggtcagtgatcggcccgtcgtacgggggtttctcgattccgtcttccgtccggtccctccaaagtctcggccaagcnccggccctccctgacccatctcgtcgggcctccgagggcctggacgggacggacgggtcttaggtatttaacgttacgttggactaacggtccgttactaaattaactaacgaaacgtaccgaaaggtaaaaccttacggtttggggttacggttcggggccgggtaccgggaaaccgtaaacgttcggtacccgttccgtaacgtcgacgcccaacggtcctccggccccttcgggtccttacccgttcttaaccgttccccc

SEQ ID NO: 345686 - DNA, 602 bp, Homo sapiens
  misc_feature: GZ8MTXP01DG9HW.52.6.A06.1.454.CMB.2.raw
  modified_base (271)..(271): a, c, t, g, unknown or other
  misc_feature (271)..(271): n is a, c, g, or t
  modified_base (335)..(335): a, c, t, g, unknown or other
  misc_feature (335)..(335): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcacgacagcaatgactattgtaacttataattctgtctctagtaccaaacaacaccccganaaacgtacccaaactcatgtattcttagagtacagtgacgtccggcccgtcggtacgggtttcncgtattccgtccttccgtcccgtcctacccgtaacgtcgtcggaccaacgacccgcccggccctccccgtagaaccctctcgtcgtcgggcctcgacgcgtggacggacgacgtnttgtaattctactgacagctactaataanacaagacaagaacgtcgttggggtcgtacggcgggtacggaaactaacgttcgtaccgttccgttacgcaacgttcccgaagtcctaccgtccccgtcgccttacgttccttccgttaacccc

SEQ ID NO: 345687 - DNA, 737 bp, Homo sapiens
  misc_feature: GZ8MTXP01EOPKU.52.6.A06.1.454.CMB.2.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatcacntctcngcaccggaacngcaatgactattgtacttatattctntctctgtacaacactaccccggacaaacgtccccaaatcatgattntttagaggtcagtcgacgtccggcccggtcgtacgggggtttctcgtacttcgtccgttccgtcccggtcccttaccgtaaacgttccgtagggacccgaacggtacccgaacccgggtcccttaccccgtacggtaaaccctacgtttccgtcgggttcggggtccccttcccgtaacggggtcgttacggggaacgggacgggtaacggggttccttaggtttaactttaacgttacttcgacgtacggtacgttacctaaatttaactaaacgaaacgaacgaaacggtaaaccgttaaggggtttcggggtacggggtttaccgggcggggttaacccgggaaacgtaaaccgttccggtaacccgttaccgttacgaccggacgccccgaacgggtccctccggtccccgttaccggtcttacctcccgtttccgttcccccg

SEQ ID NO: 345688 - DNA, 517 bp, Homo sapiens
  misc_feature: GZ8MTXP01CT8LL.52.6.A06.1.454.CMB.2.raw
  modified_base (204)..(204): a, c, t, g, unknown or other
  misc_feature (204)..(204): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
tcagcgcagtacgacacgaccggtgctcgatttagatctactgacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcnctgcaccggaacagcaatgacattggtacttataattctgtctctggtaccaacaataccccggcaaagtccccaaactcatgatctttgagtcagtgatcggccgcaggggtttcncatcgcttctccggcctccaagtctggcaagcncggcctccctgaccatctctgggctcaggctgagacgagctgattatactgcagctcatatacaagcagaaactacgtgggtgttcggcggcggggaaccaaagttcgaccgttcgtacgtcacgcccaaggcctacgcccctcggtcacgtcttcgttcccc

SEQ ID NO: 345689 - DNA, 823 bp, Homo sapiens
  misc_feature: GZ8MTXP01AUPGC.52.6.A06.1.454.CMB.2.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccaccggaaccagcaatgacattggtacttanaattttcngtctcctggtaaccaacaactaccccggacaaacgtccccaaactcatgattctttgagtcagtgacgtccggcccgtcgtaggggtttcctctacgtccgtcttccgtcccggacccttacccgtaaagtccgttgggcccaaacggcccgtaacccgggtccccttcccccgttacggaaacccctagtttccccgttccggttacggggtacccctttcccgaacggggtcccgttaggggaaaccggggaacccggtaacggggtccctttagggtaaacttttaaacgttaaccgttacggcctaacggtaccgttacccgtaagttttaaactaaaccgtaaacgtaaccgaaacggttaaaaccgtaacgggttttcgggggttaaccgggtttccggggtaccggggtaaacccgggaaacccgtaaaacggttcccgggtaaaccccgttaccccgtttaacgggtaacccaccccggttacccgaaaccgggtcccctcccgggtaacccccccgttacggggtacccttacccgttcccgttcccggtttaaccccccccgg

SEQ ID NO: 345690 - DNA, 708 bp, Homo sapiens
  misc_feature: GZ8MTXP01A82JB.52.6.A06.1.454.CMB.2.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (470)..(470): a, c, t, g, unknown or other
  misc_feature (470)..(470): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcaccggaacagcaatgactattggtacttataattctgtctctgtacaacaacacccgacaacgtcccaaancatgattcttgagtcagtcgagtccggcccgtcgtaggggtttcnctagtccgtccttccgccggtcccctaccgtaagtcgtcggaccaacgtccaaccggtccctacccgtacgaccctacttccgtcgtcgggtcctaccgtaggcgtagggacgggacgtacggtcttagtaactttacgttacncggactaccgtacgttactaagttaacaacgaaacgacgtaaacggtaaaccgttacggggtttcggggtaccgggtttaccggggacccgggtaaccgggggtaaaacccctaaacggttccggtaaccccgttacccggtaacggtccgaaccggaccccgttaaacggggtcccctccccgggtcccccgttcgggtacccttacccggtttcccgttccccgtttaaccccccg

SEQ ID NO: 345691 - DNA, 664 bp, Homo sapiens
  misc_feature: GZ8MTXP01CPCHV.52.6.A06.1.454.CMB.2.raw
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgaaccagcaatgacattgtacttataattctgtctcctggtaccaaacaactaccccggacaaacgtaccccaaactcatgattctttgagtcagtgacgtcggcccgngtacgggggtttcnctactcgtcttctccggtccctccgaacgtcgtggccaaacgccaaccgggtccctccccgtgaccctatcctcgtcgggtccctcgaacggtcgtagggaacggacggaggtcttaggactttacgttacgtgacgagtcctacgtattaacaacgaaagtacaaggtaaacttacggttgggttcggttaccgggccgggtaccggggtaaaccctaaacggttcggtaaccccggttaccgtaaaccggttcgaacggccccgaaacggtccctcccggtcccccgttcgggtaccttacccgttccgttccggtttcccccccg

SEQ ID NO: 345692 - DNA, 568 bp, Homo sapiens
  misc_feature: GZ8MTXP01CST09.52.6.A06.1.454.CMB.2.raw
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
  modified_base (436)..(436): a, c, t, g, unknown or other
  misc_feature (436)..(436): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatcnctgcacggaaccagcaatgactattggtaacttataattctgtctcctaggtaaccaacaactaccccggacaaacgtaccccaaactcatgaattctttgagtcagtgatcggccgngtagggtttcncatcgcttcgtccgcctcgagtctggcaacgcaaccggcctccctagacctatctcgtgggcctcgaggcgtggacggacgagtctagtattactagtcgacngtactacaattaacaacaagaccaaagtaacgtaacggttgggtacgtcgggcggccgggtaacaaacgttcgaccgttccgtacgcaccgccgaacgcctaccgccctcggtcacgtccgttcttaacccc

SEQ ID NO: 345693 - DNA, 772 bp, Homo sapiens
  misc_feature: GZ8MTXP01EATT3.52.6.A06.1.454.CMB.2.raw
tcagcgcagtacgacacgaccggtgctcgatttagatctactgacaggggggggtctcaggaggcagcgctctcgggacgtctccaacatggcctgggctctgctattcctcaccctcctcactcagggcacagggtcctgggcccagtctgccctgactcagcctgcctccgtgtctgggtctcctggacagtcgatcacatctctgcaccggacagcaatgacattggtacttataattctgtctcctggtaccaacaactaccccggcaaacgtccccaaactcatgatctttgagtcagtgactcggcccgtcgtacgggggtttctcgtattccggtcctttccgtccggtacccctacccgtaaacggttccgttcggggcccaaacggcccgtaacccggggtccccttacccccgttacgggaacccctaacgttcccttcggtccgggggtcccttacccgaacgggtcccgttagggaacgggacgtaacggggtccttagggtaatttaacttacgtcggactacggtcttacaatttaactaacgaaacggtcaaacggtaaaacgtaccggtttagggggtaccggtttaccgggaccggggtaccgggaaaccctaaaaccggttcgggtaaacccccgttccgtaaacccggttaccgaaccgggttccccaaaacgggggtcccctttcccgggaaccccccccgtttacggggttccccttaaccggtttccctttcccggttttaacccccccc

SEQ ID NO: 345694 - DNA, 744 bp, Homo sapiens
  misc_feature: GZ8MTXP01AZVZ8.52.6.A06.1.454.CMB.2.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcngcaccggacngcaatgactattgtaacttatattctgtctcctgtaccaacaactaccccggacaaacgtcccaaactcatgattcgtttgaggtctagtnacgtcggcccgngtacgggtttcacattcggtcttcgccggccctcaagtcgtacggcaaacgcccgaaccggtcccttcccgaggaccctagttccgtcggttcgggcctcccggaaggtccgtaggggaacggtaccgggtaacggtcgtttaggtaaacgttttaacttacgtaacgccgtaaacggtcccgtttaaacgtaaacgttaaccgtaaaccggaaaacgtaaccgaaaacggttaaaccggttacgggggtttacgggggtacccgggttacccgggggaaccgggtaaacccgggtaaaacccgtaaacggttacccggtacccgttaccgtaaccggtaccgaacccgggttacccggttacggtccccgttaccccggtccccgttcggtacccgttacccgttcccgttcccgttcccccg

SEQ ID NO: 345695 - DNA, 714 bp, Homo sapiens
  misc_feature: GZ8MTXP01DCYFT.52.6.A06.1.454.CMB.2.raw
  modified_base (227)..(227): a, c, t, g, unknown or other
  misc_feature (227)..(227): n is a, c, g, or t
tcagcgcagtacgacacgaccggtgctcgatttagatctactgacaggggtggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcaccggaaccagcaatnactattgtacttataattctgtctctggtaccaacaactaccccggcaaacgtccccaaactcaatgatcttgagtcagtgaatccggcccgtgtacggggtttctcactcgcttcctaccccggctacgaagtcctggaccaacgcgaccgggtccctacccgtcgacccagttcgtcgtcggcttaccggaggcgtaggacggacgtagggtcctaggtaacttattacgtacgtacgtaacgggtcttacctaaagttaaccttaaaccgtaaaacgaccgtaaaacggtaaaaaccgttccggtttcgggggttaccgggtttaccgggacccgggggtaaacccggggtaaacccttaaaaaccgggtttccggaacccggtttaaccccgttaacggttaccccgttacggacccccggtaaaacggtccccgtccggtcccccccgttacggttcctaacccgttcccgtttccccccgg

SEQ ID NO: 345696 - DNA, 543 bp, Homo sapiens
  misc_feature: GZ8MTXP02F25IE.52.6.A06.1.454.CMB.2.raw
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcaggggtttcncatcgnttctccggcctccaagtctggcagcacggcctcctgaccatctctgggctcagctgaggacgaggctgattagtactgacagctcatatacaagaccagaaactacgttggggtcgttcgggacggacggggaacccaaaacgttcggacccgtcctaaacgtcaaacgcccaaaggcctcgccccctcggtccacgtctcgttcccccg

SEQ ID NO: 345697 - DNA, 592 bp, Homo sapiens
  misc_feature: GZ8MTXP02G2ATP.52.6.A06.1.454.CMB.2.raw
  modified_base (358)..(358): a, c, t, g, unknown or other
  misc_feature (358)..(358): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctggtaccaacaataccccggcaaagtccccaaactcactgatctttgaggtcagtgatcggccgctaggggtttctcatcgtctctccggcctccaagtctgcagcncggcctcctcgaccatctcttcgggctccgaggctggaggacgagctagattatactgcagctcatatacaagaccaagaaactacgtttgggggtcgtttcggggaccgggtcgggaaacctaaacgtacggtaaacccgttccgtaaccgttccgaaccggcccgtaaaacggccgttacccggacccccgtcggggttacccaaccggtttcccttccggtttaacccccc

SEQ ID NO: 345698 - DNA, 540 bp, Homo sapiens
  misc_feature: GZ8MTXP02FIFIU.52.6.A06.1.454.CMB.2.raw
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagcgcagtacgacacgaccggtgctcgatttagatctactgacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcaggggttctcatcgcttctccggcctccaagtctggcagcncggcctccctgaccatcnctgggctcagctgaggacgagctgattatactgcagctcatatacaagcaagaaactacgttgggtagttcgggcggacgggaacccaaaacgtggacccgtccgtaaacgtcaacgccccaaaggcctcgcccccctcggtcctacgtcctcggtttccccccg

SEQ ID NO: 345699 - DNA, 519 bp, Homo sapiens
  misc_feature: GZ8MTXP02JEWJD.52.6.A06.1.454.CMB.2.raw
  modified_base (223)..(223): a, c, t, g, unknown or other
  misc_feature (223)..(223): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacngcaatgacattggtacttatattctgtctcctggtaccaacaataccccggacaaacgtccccaaactcactgatctttgagtcagtgatcggcccgcgtaggggtttctcatcgtcttcccgtccggctcaagtctggcngcacggcctcccngaccatctcgtggcctccgaggctgagcgagctgattattacngcagctcatanacagacagaaacncgttggtgtcggcggacggaaccaaacgtcgaccgtctacgtcacgccgaagcncgcccctcggtccacttcccg

SEQ ID NO: 345700 - DNA, 723 bp, Homo sapiens
  misc_feature: GZ8MTXP02IB98G.52.6.A06.1.454.CMB.2.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcatcacntctctgcaccgacnacatgactnttgtacttatatctgtctctcgtacaacaacgtaccccganaaccgtacccaactcatgattntttgaggtcagtgacgtcggccgngtagggtttctanactcgtccttcgccggtccctaccgaagttcgnggcacgcaccgtccttccncgaacctctctcgtcgggccttacgacggtccgtggaacggggaccgtaggtacgttaggtaactttaaacgtttaccgacgtaccgtacgtacctaacttaaacgtaaacgtaacgaaacgtaacgtaaaacggttaaacggttcggggtttacggggttaccgggttaccgggggaacccgggtaaaaccgggtaaaacccgttaaaccggtacccgggttaaaccccgttacccggtaaaccggtacccgtaaccccggtaacccggtaaccggtccccgtacccccggttacccccgttacccggtacccgtttacccgttacccgtttacccccggtcccccg

SEQ ID NO: 345701 - DNA, 529 bp, Homo sapiens
  misc_feature: GZ8MTXP02JYNKM.52.6.A06.1.454.CMB.2.raw
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
tcagcgcagtacgacacgaccggtgctcgatttagatctactgacagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctgtaccaacaataccccggcaagtccccaaactcatgatctttgagtcagtgatcggcccgcaggggtttcncatcgcttctccggcctccagtctgcagcncggcctccctgaccatctctgggcctcaggctgaggacgagctagattatactgcagctcatataacagacaagaaactcgttagggtgttacgggcggacgggaccaaaacgtcggaccgtcctacgtcacgtcccgaaggcctcgcccccgtacggtccacgtcgtcgttaccccc

SEQ ID NO: 345702 - DNA, 539 bp, Homo sapiens
  misc_feature: GZ8MTXP02FMINN.52.6.A06.1.454.CMB.2.raw
  modified_base (362)..(362): a, c, t, g, unknown or other
  misc_feature (362)..(362): n is a, c, g, or t
  modified_base (443)..(443): a, c, t, g, unknown or other
  misc_feature (443)..(443): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcgaggggtttctcatcgcttctccggccctccaagtctggcacgcnccggcctccctgacccatctctgggctccgaggctgaggacgaggctgattatactgcagctcatatacaagcaagaaacncgttagggtgttcggcggtacggaaccaacgtcgaccgtccgtacgtcacgccctaaggccgtacgccccgtcggtaccacgtcctcgttaccccc

SEQ ID NO: 345703 - DNA, 532 bp, Homo sapiens
  misc_feature: GZ8MTXP02JDURQ.52.6.A06.1.454.CMB.2.raw
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
tcagcgcagtacgacacgaccggtgctcgatttagatctactgacaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtcccaaactcatgatcttgagtcagtgatcggcccngaggggtttcncatcgcttcncccggctccaagtctggcagccacggcctcctgaccatctcgtcggctcccaggctaggacggacgaggctgtattattacttggccagctcatataccaagcaagaaactacgttggggtagtcggcggtcgggaaccaaacgtcgacgtcacgtacacgacccgaagctccgcccctcggcctacgtctcccg

SEQ ID NO: 345704 - DNA, 621 bp, Homo sapiens
  misc_feature: GZ8MTXP02JSH3E.52.6.A06.1.454.CMB.2.raw
  modified_base (377)..(377): a, c, t, g, unknown or other
  misc_feature (377)..(377): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacggaccagcaatgacattggtacttataattctgtctctgtaccaacactaccccggcaaacgtccccaaactcatgatctttgaggtcagtgactcggcccgcgtacggggtttctacgactccgtccttccgtccggtccctaccgaacgttcgtacggcacgcnccgggccctcccgtcgacctatcctcgtcgggcctcgaggccgtaggacggacgaggcctagtactttatacgtgacgtagctacgaattaacaaccgaagaacgaaacgtaaaacgtacggttggggtcggttaccggggacggaccggaaccgaaaacgtcgaacccgttccgtacggtacaccggacccgaaggcccgtcccgtccccggtacggtcctaccttccgtccgtttacccccg

SEQ ID NO: 345705 - DNA, 586 bp, Homo sapiens
  misc_feature: GZ8MTXP02GETLM.52.6.A06.1.454.CMB.2.raw
  modified_base (360)..(360): a, c, t, g, unknown or other
  misc_feature (360)..(360): n is a, c, g, or t
  modified_base (422)..(422): a, c, t, g, unknown or other
  misc_feature (422)..(422): n is a, c, g, or t
tcagcgcagtacgacacgaccggtgctcgatttagatctactgacagggggggtctcaggaggcagcgctctcgggacgtctccaccatggcttgggctctgctattcctcaccctcctcactcagggcacagggtcctgggcccagtctgccctgactcagcctgcctccgtgtctgggtctcctggacagtcgatcaccatctcctgcaccggaaccagcaatgacattggtactataattctgtctctggtaccaacaataccccggcaaagtccccaaactcatgatctttgagtcagtgatcggccgcgtaggggtttctctatcgcttctccggcctcccaagtctggcagccncgggccctccctgacccatctctcgggctccgaggctagaggacaggctagattattaacgngacagctactaatactaacaagacgaaagtaaacgtacggttgggtacggtacgggacgggaaccggtaaccgaaacgtcggtaacccgtaccgtaacgtaccgacgacccgaacgtcccgtcccgtaccccgtacggtacctaccgttcccgtaccgtccccg

SEQ ID NO: 345706 - DNA, 611 bp, Homo sapiens
  misc_feature: GZ8MTXP02G7B71.52.6.A06.1.454.CMB.2.raw
  modified_base (442)..(442): a, c, t, g, unknown or other
  misc_feature (442)..(442): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattgtacttataattctgtctctgtaccaacactaccccggacaaacgtccccaaactcatgatctttgaggtcagtgatcggccgcgtaggggtttctcactcgtcttccgtaccgcctccaagtctggcacgcaccggccctccctcgaccctagtctcgtcgggcctccgacggtcgtggacggacgtaggtcctggtaatttacttacgngtaccgagtacctactaattactaacgaaacgacgaaagtaaacgtcggttagggttcggttccggggacgtaccggggtaacaaacgttcgacccgtaccgtacgtccgaaccgaccgaacggcgtaacgcccgtaccgtcggttaccaaccgttccgtttcccccgg

SEQ ID NO: 345707 - DNA, 520 bp, Homo sapiens
  misc_feature: GZ8MTXP02I5S5D.52.6.A06.1.454.CMB.2.raw
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactaagcctgcctccgtgtctgggtctcctggacagtcgatcaccatctcctgcaccggaacagcaatgacattggtacttataattctgtctcctggtaccaacaatacccggcaaagtccccaaactcatgatcttgaggtcagtgatcgccgcaggggtttctcatcgcttctcccggctccaagtctggcagcacggcctcctgaccatctccgngctcgagctgagacgagctgtattatatgnanctacatataacaananaanaacacgtggtgtcggcggacggacgaacgtacgacgtaccgtacgtacgacgaccgaacgacgtccgtcccgtccgtccgtactacgtcg

SEQ ID NO: 345708 - DNA, 552 bp, Homo sapiens
  misc_feature: GZ8MTXP02IUE4Q.52.6.A06.1.454.CMB.2.raw
  modified_base (432)..(432): a, c, t, g, unknown or other
  misc_feature (432)..(432): n is a, c, g, or t
  modified_base (539)..(539): a, c, t, g, unknown or other
  misc_feature (539)..(539): n is a, c, g, or t
tcagcgcagtacgacacgaccggtgctcgatttagatctactgacaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtacaacaatacccggcaaagtccccaaactcatgatcttgaggtcagtgatcggcccgcgaggggtttctcatcgcttctccccggctccaagtctgcagcacggcctcccgtgacccatctctggggctcccgaggctggacggacgaggctgtattatactgcagctcattanacaagcaagaactacgttgggtcgttcgggacggtcggaaccaaaccgttcggaaacccgtcctacgtccgaacgacccgaacggctaccggtccccctacggtacnccgttcgttcccg

SEQ ID NO: 345709 - DNA, 544 bp, Homo sapiens
  misc_feature: GZ8MTXP02IDJB2.52.6.A06.1.454.CMB.2.raw
  modified_base (357)..(357): a, c, t, g, unknown or other
  misc_feature (357)..(357): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgagtcagtgatcggcccgcgtagggttctcatcgcttcctccgctccagtctgcngccacggcctccctgaccatctcgtggctcgagctgagcgaggctgattatactgcagctacatatacaagcaagaaacgtcgttagggtcgttcggacgggtaccgggaaccaaacgttcggaacccgttccgtaccgtcacgaaccccgaaggcctccgcccccgttcggtaccaccgtttcccg

SEQ ID NO: 345710 - DNA, 693 bp, Homo sapiens
  misc_feature: GZ8MTXP02IIZN2.52.6.A06.1.454.CMB.2.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctcgtgtctgggtctctggacngtcgatcaccatcnctgcaccggaacagcaatgacattgtacttataattctgtctctggtaccaaanaactaccccggacaaacgtcccaaactcatgatctttgaggttcagtgacgtcggcccgtcgtaggggtttctctacgtcgtccttcgtccggtcccttaccaagtccgtgggaccacggcctaccggggtccctcccttacggaacccctatccgttcggtcggggcccttacccgaggtccgtgggaacgggaaccggaagggtccgttaggtaatttaactttaccggtgacgtacgtactactaatactaacgaaacgacgtaaacgtaaacgttacggttacgggttcggtaccggggacgggtaaccggtaaaaccgtaaacgtaccggtaacccgttaccgtaaccggtacccgaaccgtacccgaacggtaacccgtcccgtacccccggttacggtaccctacccgttccgttacccttaacccccg

SEQ ID NO: 345711 - DNA, 811 bp, Homo sapiens
  misc_feature: GZ8MTXP02I9F9E.52.6.A06.1.454.CMB.2.raw
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctggtaccaacactaccccggacaaacgtaccccaaactcatgatctttgaggtcagtgagtccggccgcgtacgggtttctactatccgtccttccgtccggtcccctaccgtaaacgttccgttacgggaccaacggcccgaccggggtcccccttacccccgtaccggtaaccccctacgttcccgttccggtcggggtacccgttccccgaaacggggttcccgtacggggtaaccggggaacccggggtaagggtcccttaaggggtttaaacttttaacgttaaccgttacggaccgtaacggtacccgttaacctaaagttaactaaaaccgtaaaaccgacgtaaaacggtaaaacccgttaaccggtttgggggtaaccggtttcccgggggacggggttaacccgggaaaacccgtaaaaccgttcccgggtaaaccccgttacccgttaaccggtaccgaacccgggttaccccaaacggggtcccttaacccccgggtcccccgttaccgggtaccctacccgtttcccggtaccctttaacccccccg

SEQ ID NO: 345712 - DNA, 645 bp, Homo sapiens
  misc_feature: GZ8MTXP02H6QP1.52.6.A06.1.454.CMB.2.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (378)..(378): a, c, t, g, unknown or other
  misc_feature (378)..(378): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcaccggacagcaatgactattggtaacttatattcngtctctgtacacaactccccgacaaacgtcccaaactcatgatctttgaggttcagtgagtccggccgtgtaggggtttctactagtccgtccttccgtcccggcctaccgaagttccagggtcacggtaccnccgggtccctacccctcgaacctcgttccgtcgtcgggcccttaccgacgggtcgtacggaacgggcccgaagggtcctacggtaattacttaccgtacgtacgtacgtacctataaactacgaacgaacgtaacgaaacgtaacgtaacggttacggttacggtaccggtacgggaccggtaaccgtaacgtaccgtaccgtaccgtaccgtaccgaccgaccgacgtccgtccgtcccgtccgtaccgtacctccgtccgtcccg

SEQ ID NO: 345713 - DNA, 743 bp, Homo sapiens
  misc_feature: GZ8MTXP02GVUOZ.52.6.A06.1.454.CMB.2.raw
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgccaccggaacagcaatgactattaggtacttataattctgtctctgtaccaacactaccccggacaaacgtacccaaactcatgatctttgagtcagtgactccggcccgtcgtacggggtttcctcgtacgtccgtctttccgtccggtcccctacccgtaaagtcctacggggaccacggtacccgacccggggtcccccttacccccttcggaaacccctactttccgtccgttacgggggtcccttacccgaacggggccctaggggaacggggaacccggaaagggtccgttaaggttaactttaacgtttaaccgtcgggtaccacggtaccttaaccgtaaagttaaactaaaacccgggaaaacgtaaaccgtaaaacggttaaaaccggttacggggttacggggttacgggttacccggggaccgggtaacccggtaaaaccgtaacgtaccgtacccgtacgtaccgacgaccgaccgacgcccgtcccgtcccgtacgtacctaccgtccgtacccgtccccg

SEQ ID NO: 345714 - DNA, 577 bp, Homo sapiens
  misc_feature: GZ8MTXP02IFMV6.52.6.A06.1.454.CMB.2.raw
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcaccggaacngcaatgacnttggtacttataattctgtctctggtaccaacaactaccccggcaaacgtccccaaactcatgatctttgagtcagtgatcggcccgcgtaggggtttctcattccgcttctccggtcctacctaagtctggcacgccacggtccctcctccgacctactctcgtcgggctccgagtcgtgagacgaggctagtattatactgactagctactagtaatacaaagcctaaagaaactcgttaggggtcgttcgggcgggacggtaaaccgaaactcggacccgtactacgtcgaaccgcccaaacggccgttccgccccgttcggtacctccttcgttcccggttcccccg

SEQ ID NO: 345715 - DNA, 684 bp, Homo sapiens
  misc_feature: GZ8MTXP02JWX35.52.6.A06.1.454.CMB.2.raw
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaactaccccggcaaagtccccaaactcatgatctttgagtcagtgatcggcccgcgtaggggtttctcgatcgtcttccgtccgcctccaagtctggcagcncggcctcctgaccntctctcgggctccgtaggctaggacggaccggaggtcctaggtaactttagttaccgttggaccgaacggtccttccgtaaatttaactaaccgaaaggtacccaaaaggtaaaacctaaccgggtttagggggtacggtttccggggtacggggtacccgggggaaaaccctaaaaccggtttcggaaaccccggttacccgttaaacggtacccgaaccgggtaccccgaaaacggggtccgtaccccggtccccccggttaccgggtcctaacccgttacccgttaccggtttcccccccgg

SEQ ID NO: 345716 - DNA, 544 bp, Homo sapiens
  misc_feature: GZ8MTXP02FX01A.52.6.A06.1.454.CMB.2.raw
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (426)..(426): a, c, t, g, unknown or other
  misc_feature (426)..(426): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccggaacagcaatgacattggtacttataattctgtctcctggtaccaacaactaccccggcaaacgtccccaaactcatgatctttgaggtcagtnatcggccgcagggtttcncatcgctctccggcctccagtctggcacgcacggcctcctgacccatctctgggctccgaggcgtgaggacgaggctagtattatactgctagctcattanaacaagcaagaaactacgttagggtgttccggacggacggtaacctaaacgcgacccgttacgttaccgacacgacccgaacgcgtccgccccgtacggctacgtcctcgttcccccg

SEQ ID NO: 345717 - DNA, 540 bp, Homo sapiens
  misc_feature: GZ8MTXP02I67KR.52.6.A06.1.454.CMB.2.raw
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctctggtaccaacaataccccggcaaacgtcccaaactcatgatctttgaggtcagtgatcggccgnaggggtttcncatcgtctctccggcctccagtctggcagcacggcctcctgaccatctctcgggcctccgaggctggaggacgagctgattatactgcagctcatatacaagcaagaactcgttagggtcgttcgggacggtacgggaacctaaaacgtcggaacccgtccgtacgtcgaaccgccaaggcctcgccccctacggtcctacgtctccgttccccc

SEQ ID NO: 345718 - DNA, 712 bp, Homo sapiens
  misc_feature: GZ8MTXP02GD1XL.52.6.A06.1.454.CMB.2.raw
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgacngcaatgacattgtacttatattctgtctctgtacaacactaccccganaacgtacccaaactcatgatctttgagtcagtgatccggccgngtacgggtttcnctatcgcttcgtccggcctccgaagtctacggcacgccaccgggtccctcccgtacgaacctgtcctcgtcggggtccctccgaacggtcgtacggacgggaacgtacggggccttagggttaaactttacgttacgttcggacctacggtaccttaacctaagttaaacttaaccggaaactaaccgaaacggtaaaaacgtttcccggttaaggggtttcgggttaccgggggaccggggaaacccggtaaacccggtaaaacgttccggtaaccccggttaacccgttaccggttacccgaaaccggtcccccggtaaaacggcccgtacccccggtacccccgtaccgggttacccctaccgtttcccggtttccccgtttaaccccccc

SEQ ID NO: 345719 - DNA, 573 bp, Homo sapiens
  misc_feature: GZ8MTXP02JFBJY.52.6.A06.1.454.CMB.2.raw
  modified_base (322)..(322): a, c, t, g, unknown or other
  misc_feature (322)..(322): n is a, c, g, or t
  modified_base (466)..(466): a, c, t, g, unknown or other
  misc_feature (466)..(466): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccaccggaaccagcaatgactattggtacttataattctgtctcctggtaccaacaactaccccggacaaacgtccccaaactcatgatctttgagtcagtgatcggcccgngtaggggtttctcatcgcttccgccggccctccgaagtctggcacgcaccgggccctcccgtcgacccatccgtcgtacgggtcctaccgaggtcgtaggacgggacgaggcctagtattactagtcgcagctacatatacaancaagaaacctagttcggtgtcggcggacggaacaacgtcgaccctccgtacgtccgaacgccccgaagcccgtccgccccgtcggcctacccgtctccgttaccccc

SEQ ID NO: 345720 - DNA, 528 bp, Homo sapiens
  misc_feature: GZ8MTXP02IFOCN.52.6.A06.1.454.CMB.2.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
tcagcgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacagcaatnacattgtacttataattctgtctctgtaccaacaactaccccggnaaacgtaccccaaactcatgatctttgagtcagtgagtccggcccgngtaggggttctcatcgcttccctccggctcaagtctggcngcacggcctccctgaccatctcgtggcctcgaggctgacgcgagctagattattactgcagctanatatacaagacaacgaaactcgttagggtcgtcgggcggacggaccaacgtacgaccgtcaccgtcacgcccgaacgtctaccgcccgtcgtcaccgtcccg

SEQ ID NO: 345721 - DNA, 672 bp, Homo sapiens
  misc_feature: GZ8MTXP02HH3AG.52.6.A06.1.454.CMB.2.raw
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccaccggaaccagcaatgactattgtacttataattctgtctctgtaccaacactacccgacaaactaccccaaactcatgattctttagaggtcagtgacgtccggaccgtcgtacggggtttctcgtacgttccgtcttccgtccggtccctacctacgtcgtcggacacgccgtccggcccttcccgacgtacccacttccgcgttcggggcccttcggacggtcgtacggggaggaccggagtcgtaggttaatttacgtacgttgcgtaatctactaatacgtaaacgaacgtaaccgaaagtaaaaccgtcggtttaggggttaccggttcgggggaccgggtacccggtaaaaccgtaaccggtaccggtacccgttacgtaacccgtcgaccggtaccgacggtccgtacccggtccccgtacggtcctccgttccgttcccggtttcccccg

SEQ ID NO: 345722 - DNA, 618 bp, Homo sapiens
  misc_feature: GZ8MTXP02GE30D.52.6.A06.1.454.CMB.2.raw
  modified_base (242)..(242): a, c, t, g, unknown or other
  misc_feature (242)..(242): n is a, c, g, or t
  modified_base (355)..(355): a, c, t, g, unknown or other
  misc_feature (355)..(355): n is a, c, g, or t
tcagcgcagtacgacacgaccggtgctcgatttagatctactgacaggggcctgggaggtccctgagactctcctgtgcaggctctgcatttcccttcagtaactatgctatcgattgggtccgccaggctccaggcaagggactggagtgggtggcagttatatcagctgatggaggcaataagtattacgcagattctgcgagggccattcaccatatccagagacaactcccaagatangatatatctgacaaatgaaacagcctagacgaccgtaggaacggacaacggcctaattatatttattgtgcgttcggaggggcaggtcgcctcggccacgtgatgtcttttgntttcgaggggacaaggtcagtttcgctaccgtctccgtcacgccctaccgaacgaccgggcccaacgttcccggtcccttcccccgtcggaccctacccctcccgtaccgaacgtacggccctacccgttcggacgggggaccacggacgcccggccgtcggggctcggccgtacggtacgaaacggtaccttaccgttacccgtaacgtaaaccggtaccgttacggacccgttagggacggtaccggggtcgtaaccgggg

SEQ ID NO: 345723 - DNA, 658 bp, Homo sapiens
  misc_feature: GZ8MTXP02IZ2X1.52.6.A06.1.454.CMB.2.raw
  modified_base (219)..(219): a, c, t, g, unknown or other
  misc_feature (219)..(219): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcaccggaacngcaatgacattggtacttataattctgtctctgtaccaacaataccccgacaaacgtaccccaaatcatgatctttagaggtcagtgactcggccgngtagggtttcncactcgtcttctccggcctaccagtctaggcacgcnccggtcctcctacgaccatcgtcgtcgggcctcgagtctggagaacgngtctagtactttagtacgtgaccgtagacctactaattaacaaacgaacgaaccaaaacgtaaacgtacggtttacggggttcgggttaaccgggcggggaaccggtaaaccgtaaaaccgttccggtaaacccggttacccgtaaccggttaccgaacccggtaccccggtaaaacggccccgtttccgggaacccccccttcgggtaccctaacccgttcccgtttaccccgggtttaccccccg

SEQ ID NO: 345724 - DNA, 658 bp, Homo sapiens
  misc_feature: GZ8MTXP02F6AAW.52.6.A06.1.454.CMB.2.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctctgcaccggaacngcaatgactattgtacttataattctgtctctgtaccaacatacccgnaacgtcccaactcatgattctttgagtcagtgacgtcggacccgtcgtacggggtttcctcgtacgtccgtccttaccgtccggaccccttaccgaacgttcctaggggacctacggcccgtacccggggtacccccttccccgttacggaacccctacgttcccgtcgggttccgggggtcccttacccggaaggggtccgtagggaacggggtaacggtacggccgttagtaactttacgttaccgtgacctacgtcacgtaaatactaacaagacctaagaaacttcggttagggtcgtacgggaccggacggtaacaaacgtccgaccgtactaacgtcaacgacccgaaggccctccggtccctcggtctacgtccgtccttacccc

SEQ ID NO: 345725 - DNA, 671 bp, Homo sapiens
  misc_feature: GZ8MTXP02HFWI3.52.6.A06.1.454.CMB.2.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (322)..(322): a, c, t, g, unknown or other
  misc_feature (322)..(322): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcaccgaacngcaatgacnttgtacttatatctgtctctgtaccaanactaccccgganaaacgtccccaactcgatgatctttgagtcagtnagtcggccgngtacggggtttcncgtatcgtccttccgtccggtacctccctaagtcgtacggcacggccgaccgggtcccttcccgtacgaccctagtcctccggtcgggtcctccgacggtcgtacggaacgggacggtaacggtccgttagtaactttaacgtttaccgtacgtactacgtactactaataacgaacgaacgtaacgtaaacgtaaacgttacgggttacgggttcgggtaccggggaccgggtaaccggtaacccgtaaaccggtaccggtacccgtacgtacgaccgacccgtaccgtaccggtccgtcccggtccccgttacgtaccctaccgttacccgttaccccgttaccccg

SEQ ID NO: 345726 - DNA, 678 bp, Homo sapiens
  misc_feature: GZ8MTXP02JT6QG.52.6.A06.1.454.CMB.2.raw
  modified_base (205)..(205): a, c, t, g, unknown or other
  misc_feature (205)..(205): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccntctctgcaccggaacagcaatgactattcggtattatattctgtctcgtacgtaacaacaactaccccgacaacgtccccaaactcatagtacttcgtttagaggtacaggttcgaacgttccgggcccggtaccggttaggggtttcctacgtacgtccgttccttccgtccgaccctaccgtaagtcgtcggacacggccgtacccggggtcccttacccggtacctaacccgtcttccggtcgtcgggtcccgtacccgaggtcgtacggacgggtacggaacgtcgtagttactttaactacgtcaccgtagtacctactaagtaactaacggaacgtaaactaaagtaaacggttcggtttacggggtcgggttaccgggaccggaacggtaaaccaacggtcgtacccgtacgtaccgcaaccggtccacggcctcccgcccgtcactacccgttcgtcctcccccg

SEQ ID NO: 345727 - DNA, 685 bp, Homo sapiens
  misc_feature: GZ8MTXP02HMRXO.52.6.A06.1.454.CMB.2.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatcctctgccaccggaaccagcaatgacattggtacttatattctgtctctgtaccaacaactaccccgacaacgtacccaaatcatgattctttgaggtcagtgacgtcggcccgngtggggtttctctatcgtcttccgtccgcctaccgagtcgngtcacgcgccggtccctaccgtcgacctatcgtccgtcgggccctaccgaggtcgtaggaacgggtacgacggtcgtagtaactttagttacgtcgacgacgtaccttattaaacgtaactaaacgaaacgaccgtaaaacgtaaacccgtaggggttttcggggttacggttaccgggggaccggggaacccggggtaaaacccaaaaccggtttccggaaaccccgttccggttaaaccgtcccgaaaccggacccgaaacgggtcccctaccggtacccccggttcgtaccctacccttacccggtttcccgtttaaccccccg

SEQ ID NO: 345728 - DNA, 584 bp, Homo sapiens
  misc_feature: GZ8MTXP02JCF81.52.6.A06.1.454.CMB.2.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaacgtccccaaactcatgatctttgaggtcagtgatcggcccgcaggggtttctcatcgccttctccgcctccaagtctggcagcnccggcctccncgaccatctctgggctccgagctgagacgagctgtattagtactgcacgctacatactaacaagacaagtaaactacgtttaggggcgtttaccgggacgggacggtaaacctaaaacgtcggtaaaccccgttactaccggtactaaccgcccgaaacggccggttcccaacccccggttcggtaccctaccttacccgttcgtttacccccc

SEQ ID NO: 345729 - DNA, 584 bp, Homo sapiens
  misc_feature: GZ8MTXP02IT66Z.52.6.A06.1.454.CMB.2.raw
  modified_base (460)..(460): a, c, t, g, unknown or other
  misc_feature (460)..(460): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacagtcgatcacatctcctgcaccggaccagcaatgactattgtacttatattctgtctctgtacaacaactaccccgacaaacgtccccaaatcatgatctttgaggtcagtgacgtccggcccgcgtaggggtttctcacgtccgtcttccgtccggcctccgtaagtctggccacgccaccgggtccctcccgtacgaccctatccgtcgtcgggccttccgaggtctgggacgacggaggcttagtattacgtatgctagctactattanacaagacaaagtaaactcggttggtacggtcggacggacgggtaaccaaacgtcgacccgttacacgtcgaacgcccgtaacgccgttccgccccgtacgtccaccgttccgtccgttcccccg

SEQ ID NO: 345730 - DNA, 699 bp, Homo sapiens
  misc_feature: GZ8MTXP02GT8G9.52.6.A06.1.454.CMB.2.raw
  modified_base (293)..(293): a, c, t, g, unknown or other
  misc_feature (293)..(293): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctgtaccaacactaccccgacaacgtccccaactcatgatntttgagtcagtgacgtcggccgcgtagggtttctactactaccgtccttcgtccggtccctaccgaacgttcgtcggcaggcccaccggtccctccctcgtacccgtacgtcctccgttcgggaccctccgtacggtcgtacggggaacgggacccggtaggtacccgttaggttaaactttacgttaccgttacgaccgtaacgttcgtaccctaatacgttaacgaaacgacgtaaacgtaaacccgtaggtttacggggttccgggttaccgggaccgggtacccgggtaaacctaaccggttacgtaccccggttacgttaacccgtacgacccgtacccgtaacggtcccgtacccggtccccctacccgggtactaccccgttctaacccggtttccccc

SEQ ID NO: 345731 - DNA, 695 bp, Homo sapiens
  misc_feature: GZ8MTXP02GZO7A.52.6.A06.1.454.CMB.2.raw
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccaccggaaccagcaatgactattgtacttataattctgtctctgtaccaacactaccccggacaaacgtccccaaactcatgattctttgaggttcagtgacgtccggccgcgtacggggtttctctacgtcgtccttcgtccggtccctaccaagtcgtggcacgccnccgggtccctacccgtacgacccngttccgtcgtcggggtcctccgaacggcgtaggacgggacggtacgcgtagtaattacttacgcgacacgtctacaatacgtaacgaaacgacgtaaacgaaaacgttcgggttcgggttacggttaccggggaccgggtaaccgggggtaaaacccctaaaaccgttccgggtaaacccccgttaccggttaaaccgttaccgaaccggtaccccgtaaacgggcccgttaccccggtcccccgttacgggtcccttaacccgttcccgtttacccggtttaaccccccc

SEQ ID NO: 345732 - DNA, 639 bp, Homo sapiens
  misc_feature: GZ8MTXP02GSRCW.52.6.A06.1.454.CMB.2.raw
  modified_base (133)..(133): a, c, t, g, unknown or other
  misc_feature (133)..(133): n is a, c, g, or t
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacngggtcctgggcccagtctgccctgactcagcctgcctcgtgtctgggtctcctggacngtcgatcacntctctgcacgacngcaangacnttgtacttatattctgtctctgtacaacactaccccgnaaacgtacccaatcatgatcttgagtcagtgagtccggccgtcgtaggggtttctcagtccgtcttccgtccggccctaccgagtcgtagcacgcgccggtccctcctcgaaccncgtctcgtcggtcctcgacggtcgnggacggacgaggctagtatttactacgttcgacgtacgtactacgtaataattaaccgaaagacctaaaagtaaacccgtaggtttacgggttcggttaccgggaccggggttaaccgggaaaccgtaaacgttacggtaacccgttacctacggttaccgaaccgtaacccgaaacgggtccgtccccggtaaccccgttccgggtcctaaccgtttccgtttacccgtttcccccg

SEQ ID NO: 345733 - DNA, 706 bp, Homo sapiens
  misc_feature: GZ8MTXP02FKHKX.52.6.A06.1.454.CMB.2.raw
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
tcagcgcagtacgacacgaccggtgctcgatttagatctactgacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaacagacaatgactattgtacttatattctgtctctagtaccaacaactaccccgacaacgtaccccaaatcatgattctttagaggtcagtgacgtccggcccgngtacgggtttcnctactccgcttccgtaccgcctacgagtctcggcacgccgaccggccctcctacgacctactcgtacgtcgggtcctccgaggtctacgggacgggtaacggtacggtacgttaggttaactttacgttacgtcgaaccgtacgtacttacgtaaacgttaattaaaccgaaacgggtaaacctaaaacgggtaaaaccgtttaacgggtttcgggggttacgggttacccggggaccggggtaaacccggtaaaacccgtaaaaccggttccgggtaaaaccccgttccgtaacggttacccgaaccggtacccgaacggtccgtaccccggtccccgtacggtcctaccgtccgtttcccgttaccccccg

SEQ ID NO: 345734 - DNA, 745 bp, Homo sapiens
  misc_feature: GZ8MTXP02F2VFX.52.6.A06.1.454.CMB.2.raw
  modified_base (332)..(332): a, c, t, g, unknown or other
  misc_feature (332)..(332): n is a, c, g, or t
  modified_base (422)..(422): a, c, t, g, unknown or other
  misc_feature (422)..(422): n is a, c, g, or t
tcagcgcagtacgacacgaccggtgctcgatttagatctactgacaggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatccacatctctgccacccggaacagacaatcgactagttcgttaacttattaacttctgtcctccgtaagtaaccaaacaaccgtaccccggaactaaacccgtacccaaacttgatagtattcgtttaggngtacagtagtaccgccggccgtaggttacggtttcacttacgtccgttccgttaccggtcgtaccccgttaaccgtagtcgtcggaaccncggacccgtcccgtccctctacgtaccctgttccgtacggtgtacctcggaggtgaaccgggtaagggacgtacgtatttaaggtttaaacttacgtacgcgtaactcgtaactaactaacttaaaacggaacaaaccgtacgtaaaacggttaacggtttcggggttacgggtacgggtaccggggaaccggtaaaccgtaaaaccgtacggtacccgtaaaccgttaccgaaccgtaacccggacccgtaacggtacccgtccccgtcccccggttacccgtcgttccccttaacccgttcccccgttaaccccgtccccc

SEQ ID NO: 345735 - DNA, 605 bp, Homo sapiens
  misc_feature: GZ8MTXP01A6FVT.45.36.D03.1.454.CMB.2.raw
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
tcagacgcgatcgacacgaccggtgctcgatttagctgcgtcacgatctctcttggggccctggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccacctctcctgcagggccagtaggagtgtcagtaagtacttaggctggtaccaanagaaaccnggccaggctcccaggctcctnatccatgatgcatccaangggtccctggctcccagacaggttccccgnggcaggtcggtctgggacnggcgtcactctacgaccgtcagcacgccgtggacgcctgatgtatttcgcttagtttacttcgttgtcgtacgtcgtacgtccgttccgcccgtaccgcccgtccgttccgtaccgggtttccggggaccggggggtaccggtaaggggtacgggacggtagttacgggaacggtaaccggttaacggttcgggttacgggccgtcggaaccgtacccgtagttccgttcgttccgttccg

SEQ ID NO: 345736 - DNA, 621 bp, Homo sapiens
  misc_feature: GZ8MTXP01BAXTV.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (404)..(404): a, c, t, g, unknown or other
  misc_feature (404)..(404): n is a, c, g, or t
  modified_base (468)..(468): a, c, t, g, unknown or other
  misc_feature (468)..(468): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacnggccaggctcccaggcctcctcatccatgatgcaatcccaacgacggggttcccctagggcccgttacccaggaccgtaggggtttccccccgtgggccgtaggttcggggtcctagggggaaccnggtacgtttccacttctcaccggtcaagcagcctggagcctgatgtatttgcttagtttacttntgtctacgtctacgtccgttcccgccgaccggccgtccgtccgtaccgtttccggggccggggggtaccgtgggggtggagggtacgttggaaggaaccggttaacgttggttcgggtctcggccgtacccgtattccgtcgttcgttaaccg

SEQ ID NO: 345737 - DNA, 566 bp, Homo sapiens
  misc_feature: GZ8MTXP01CUG9M.45.36.D03.1.454.CMB.2.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctntcctgcagggccagtaggagtgtcagtaagtacttaggctggtaccaacagaaacctggccaggctcccaggctcctcatccatgatgcatccaacagggtcccctgggcctcccagacaggttccgnggccaggtggtctgggacaaggtacttcactctaccgaccgtnacgcacgcctggacgcgtgattgtatttcgacttagtttacttcgtcgtacagcgtacgtccgttccgccgaccgcccgtctcgtacggttccggggcgggggtaccgtagggtggaagtgttggacgacgtacgtggttcggcgttcgcctaccgtctcgtcgttccttcgttaacgttccg

SEQ ID NO: 345738 - DNA, 538 bp, Homo sapiens
  misc_feature: GZ8MTXP01C9LV7.45.36.D03.1.454.CMB.2.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (486)..(486): a, c, t, g, unknown or other
  misc_feature (486)..(486): n is a, c, g, or t
  modified_base (519)..(519): a, c, t, g, unknown or other
  misc_feature (519)..(519): n is a, c, g, or t
  modified_base (531)..(531): a, c, t, g, unknown or other
  misc_feature (531)..(531): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccacggaaaattgtgttgacacagtctccaggcaccctgtctctgtctccaggggagacagccaccctctcctgcagggccagtaggagtgtcagtaagtacttaggctggtaccaacagaacctggccaggctcccaggctcctcatcatgatgcatccaanacggggtcccctgggccgtcccagacagggttccgnggcccaggtgggtctggggacaagtagttcactcncaccgtnagcagctgagctgatgtatttgctagtttacttctgtctagcgtacgtcgttccgccgacgccgtctcgtaccgttcgggccgggggtaccgaggggtggaagngttaggagacgaacgtgttgggcttcgcacgtntctcgttcttcncttcccg

SEQ ID NO: 345739 - DNA, 532 bp, Homo sapiens
  misc_feature: GZ8MTXP01EN4C4.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (345)..(345): a, c, t, g, unknown or other
  misc_feature (345)..(345): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (471)..(471): a, c, t, g, unknown or other
  misc_feature (471)..(471): n is a, c, g, or t
  modified_base (482)..(482): a, c, t, g, unknown or other
  misc_feature (482)..(482): n is a, c, g, or t
  modified_base (513)..(513): a, c, t, g, unknown or other
  misc_feature (513)..(513): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtacttaggctggaccaanagaaacctggccaggctcccaggctcctcatccatgatgcatccaaacgcggggtcccctgggcctcccagacaggttccgnggccaggtgggtctggggacagagttcactcncaccgtnagcagctgagctgatgtatttgctagtttacttctgtcagcgagtcgttccgccacgccgctcgtacgtttcggggcgggggaccgnggggtggaagngttggaggacgaacgtggttggcgttgcacntctgttcttcttcgttccg

SEQ ID NO: 345740 - DNA, 592 bp, Homo sapiens
  misc_feature: GZ8MTXP01DBL8P.45.36.D03.1.454.CMB.2.raw
  modified_base (354)..(354): a, c, t, g, unknown or other
  misc_feature (354)..(354): n is a, c, g, or t
  modified_base (404)..(404): a, c, t, g, unknown or other
  misc_feature (404)..(404): n is a, c, g, or t
  modified_base (466)..(466): a, c, t, g, unknown or other
  misc_feature (466)..(466): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaccaacagaaacctggccaggctcccaggctctcatccatgatgcatcccaacgacgggtcccctgggcccgtccccaggacctacgggtttcccgnggcccaggtggggtctggggacaagggtacgttccactctacgacccgtnacggcacgcctgacgcctgatgtattttgcttagtttactctgtcagcgacggtccgttccnccgacgcccgctcgtacggtttcgggccgggggtaccgnggggtcggaagngttggaacgacggtaacgtgggttacggcgttacgcaacccgtgttcgtcggttccttccgttaacgtttccccg

SEQ ID NO: 345741 - DNA, 576 bp, Homo sapiens
  misc_feature: GZ8MTXP01CNA8U.45.36.D03.1.454.CMB.2.raw
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcagggccagtaggagtgtcagtaagtacttaggctggtaccaanagaaacctggccaggctcccaggctccncatccatgatgcataccaacgcgggtcccctgggccctcccagaccagggttccgnggccaggtgggtctggggacaagagttcactctcaccgtcagcagcctggagctgatgtattttgcttagtttacttcgttgtcgtagcgtacgtccgttccgccgaccgccgccgtcgtaccggttcggggacgggggaccgtgggggtggaaggtagttggaacggacggtaaacgtggttacggcgttcggaacactaacgttcgtgttccttcgttcgttcccg

SEQ ID NO: 345742 - DNA, 556 bp, Homo sapiens
  misc_feature: GZ8MTXP01CSEMF.45.36.D03.1.454.CMB.2.raw
  modified_base (200)..(200): a, c, t, g, unknown or other
  misc_feature (200)..(200): n is a, c, g, or t
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaattgtgttgacacagtctccaggcaccctgtctctgtctccgagggganacagccacctctcctgcagggccagtaggagtgtcagtaagtcttaggctgacaacagaactggcaggctccaggctctnatccatgatgcataccaacgcgggtccctgggcctcccagacaggttccgnggcccaggtgggtctgggacaaggtgttcactctacgaccgtcaagcacgccgtggacgccgtgattgtattttgacttacgtttacttcgttgtctagcgtacgtccgttccgccgaccgcccgtctcgtaccggtttcgggccgggggtaccgacggggtggaagtgttaggacgacgtaacgtgttggcttcggaacactaagtctcgttcttcgcgttccg

SEQ ID NO: 345743 - DNA, 689 bp, Homo sapiens
  misc_feature: GZ8MTXP01AY8LW.45.36.D03.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (658)..(658): a, c, t, g, unknown or other
  misc_feature (658)..(658): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccacctctcctgcagggccagtaggagtgtcagtaagtacttaggctaggtaccaacagaaacctggccaggctcccaggcctccncatccatgatcgcactcccaacgacggggttcccctgggcccgttaccccgagaccgtacggggttcccgtgggccccgtagggttggggtctagggggactaaagggtacgtttccaccgttctacccgacccggttcaacggccaacggtcccgtgggacgtccgtagtagttgtagttttgacgttaagttttaccttcgttcgtactacggtccgtacggtcccgttacccggaccgtaccggtcccgtccgttaccgtaccgggtttccgggggaccggggggtaccgtagggggtcgggaaggtggttacgggacgttaacggtaaacgttcgggttacggttcgttacgccgtaccgtnttaccgtcgttccttcgttaacgtttccccg

SEQ ID NO: 345744 - DNA, 547 bp, Homo sapiens
  misc_feature: GZ8MTXP01ALUAS.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (300)..(300): a, c, t, g, unknown or other
  misc_feature (300)..(300): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (502)..(502): a, c, t, g, unknown or other
  misc_feature (502)..(502): n is a, c, g, or t
  modified_base (532)..(532): a, c, t, g, unknown or other
  misc_feature (532)..(532): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgtagggccagtaggagtgtcagtaagtacttaggctggtaccaanagaaacctggccaggctcccaggcctctnatccatgatgcatccaacgcgggtcccctggccgtcccagacaggttccgnggcaggtgggtctgggaacagngttcactctcaccgtnagcacgctggacgtccgtgatgtattttgacttagtttacttctgtcaggtcagtccgttccgccaccgtccgcttcgtaccggttcggggcgggggtaccgaggggtggagngtaggagtaccgagttggttgcgtgcaacnctcttgtcttcgtcc

SEQ ID NO: 345745 - DNA, 554 bp, Homo sapiens
  misc_feature: GZ8MTXP01A4IYS.45.36.D03.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (395)..(395): a, c, t, g, unknown or other
  misc_feature (395)..(395): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaanagaacctggccaggctcccaggctcctcatccatgatgcatccaacgngggtcccctgggccgtcccagacaggttccgnggcccaggtgggctggggacaaggagttcactctcaccgtnagcagcctggacnctgattgtatttgctagtttactctgtcagcgacgtccgttccgccaccgccgctcgtaccgtttcggggcgggggtaccnggggtggaagngttggacgacgtaacgtggttacgggcttcggcctaccgtgttcgttcgttccttcgttcgttcccg

SEQ ID NO: 345746 - DNA, 567 bp, Homo sapiens
  misc_feature: GZ8MTXP01AS9HO.45.36.D03.1.454.CMB.2.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (340)..(340): a, c, t, g, unknown or other
  misc_feature (340)..(340): n is a, c, g, or t
  modified_base (489)..(489): a, c, t, g, unknown or other
  misc_feature (489)..(489): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccacctctcctgcgagggccagtaggagtgtcagtaagtacttaggctggacanagaactggcagctccagctcctnatccatgatgcatccaacgcgggtcccctgggcctcccgagaccgtagggttccgnggccctaggtggggtctgggggacaaggtacgttcactctaccgaccgtcagccagccgtggacgcgtgatgtatttgctagttacttctgtcagcgacgtccgttccgccgtaccgccgtctcgtacggttcggggcgggggtaccgnggggtcggaagtagttggagacgtaacgtggttcggcgttacggcctacctaagttctcgttccttcgttcttccccg

SEQ ID NO: 345747 - DNA, 544 bp, Homo sapiens
  misc_feature: GZ8MTXP01DAX5I.45.36.D03.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (347)..(347): a, c, t, g, unknown or other
  misc_feature (347)..(347): n is a, c, g, or t
  modified_base (497)..(497): a, c, t, g, unknown or other
  misc_feature (497)..(497): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctaggtaccaanagaaacctggccaggctcccaggctcctcatccatgatgcatcccaaagcggggtcccctgggccgtcccagaccaggttccgnggcccaggtgggtctggggacaaggagttcactcctcaccgtcagcagcctggacgctgattgtattttgcttagtttacttctgtcagcgacgtccgttccgccacgcccgctcgtaccgtttcgggcgggggaccgaggggtggaagngttggagacgaacgtggnggcttcgcacngtctgttcttcgcttccc

SEQ ID NO: 345748 - DNA, 702 bp, Homo sapiens
  misc_feature: GZ8MTXP01C7W5X.45.36.D03.1.454.CMB.2.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaaccggaaaattgtgttgacacagtctccaggcaccctgtctctgtctccgagggganacagccaccctctcctgcagggccaggtaggagtgtacagtaagtacttaggctaggacaacagaacctggcaggctccagctcctcatccatgatgacactccaacgacgggggtcccctgggcctaccccgaggacgtacgggtttcccggnggacccgtagggtgggtcgtacggggacaaggtacgttccacttccgtaccgacccggtcgaacggccacggtaccgtacgggacgtccgtagtagttagttacgttttcgtacgtttaagttttaccttcgttacgtacgtacggtaccggtacggttcccggtttaccccgacccgtacccgtccccgtcccgttaccggttacccggggtttccgggggtaccggggggtaacccggtagggggtacgggaacggtagttacgggaacggttaaaccggtaacgtgggttcggcgttacgaaccgaccgtaacgttcgttcgttccttcgttaaccgttcccg

SEQ ID NO: 345749 - DNA, 603 bp, Homo sapiens
  misc_feature: GZ8MTXP01CWWR8.45.36.D03.1.454.CMB.2.raw
  modified_base (201)..(201): a, c, t, g, unknown or other
  misc_feature (201)..(201): n is a, c, g, or t
  modified_base (344)..(344): a, c, t, g, unknown or other
  misc_feature (344)..(344): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcagggccaggtaggagtgtcagtaagtacttaggctggtaccaacagaaacctggccaggctcccaggctcctcatccatgatgcatccaacgcgggtcccctgggcctcccagacaggttccgnggcccagggtgggtctggggacaaggtacgttccactctacaccggtcaagccagcccgtggacgccgtgattggtattttgcttagtttacttctgttcagtcgtacggtccgttcccgcccgtaccgccccgtcgttccgtaccggtttccgggggccggggggtaccgtagggggtcggaaggtacgttgggacggaacggtaacgtggttcgggcgttcggcctaccgtaattcgtcgttccttcgttcttcccg

SEQ ID NO: 345750 - DNA, 556 bp, Homo sapiens
  misc_feature: GZ8MTXP01AKE9Y.45.36.D03.1.454.CMB.2.raw
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (457)..(457): a, c, t, g, unknown or other
  misc_feature (457)..(457): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtactaggctggaccaacagaaacctggccaggctcccaggctcctcatccatgatgcatccaaacgcgggtcccnggccgtcccagacgtaggttccgnggccaggtgggtcgtggggacaagtacgttcactctcacgtcagcacgcctggacgcctgattgtatttgacttagtttacttctgtcagcgacgtccgttccgcctacgcccncgttcgaccggtttcggggcgggggaccnggggtcggaagngttggacgacgtaacgtggttcggcttcggaacacctgtctcgttcttcgcgttcccg

SEQ ID NO: 345751 - DNA, 563 bp, Homo sapiens
  misc_feature: GZ8MTXP01BJGTJ.45.36.D03.1.454.CMB.2.raw
  modified_base (201)..(201): a, c, t, g, unknown or other
  misc_feature (201)..(201): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatcccaacgcggggtcccctgggccgtccccagacctagggttcccgtggcccaggtgggtctggggacaagagttcactctcaccgtnagcagcctgagctgntgtatttgctagtttacttctgtcagcgagtccgttccgccgtaccgcccgcgtcgtaccggtttcggggccgggggtaccgaggggtggaaggtagttggacgacgtaacgtggttcggcttcggccacgtaactcgtcgttcttcgttcttcccg

SEQ ID NO: 345752 - DNA, 536 bp, Homo sapiens
  misc_feature: GZ8MTXP01B7SOG.45.36.D03.1.454.CMB.2.raw
  modified_base (311)..(311): a, c, t, g, unknown or other
  misc_feature (311)..(311): n is a, c, g, or t
  modified_base (479)..(479): a, c, t, g, unknown or other
  misc_feature (479)..(479): n is a, c, g, or t
  modified_base (526)..(526): a, c, t, g, unknown or other
  misc_feature (526)..(526): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctcccaggctcctcatccatgatgcatccaacncgggtccctggccgtccagcaggttccgtggcccaggtggtcgtggggacaaggattcgactctcaccgtcagcagcctgagctgatgtattttgtatttactctgtctagcaggtcgttacgccacgccgctcgtacgtttcggggcgggggtaccgaggggtcggnggaagtggacgacgacgtggtgcgttgactaacgatcgtgtcttctnttccgtcccg

SEQ ID NO: 345753 - DNA, 732 bp, Homo sapiens
  misc_feature: GZ8MTXP01CBAO5.45.36.D03.1.454.CMB.2.raw
  modified_base (370)..(370): a, c, t, g, unknown or other
  misc_feature (370)..(370): n is a, c, g, or t
tcagacgcgatcgacacgaccggtgctcgatttagctgcgtcacggatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctcggtaccaacagaaacctggccaggcctcccgaggcctcctcatccattgatcgcactaccgaacgtacggggttcccctgggtcccgtacccgagtaccgtacgggtttcccgngggtacccgtaggggttcggggtcgtacgggggacaacgggttacgttccgaccttcctcgaacccgtcacggcacggcccgtgggacgccgtaggtaacttggttaatttttcgggactttacggttttaccttcgtgtacgtacgtaccgggtcggttccggtttccccgcccgtaaccgggtccccgtaccgttcggttaacccgggtttccggggggacccggggggtaccgtaggggggttacggggaacgtaggttcgggaaacgggaccggtaaacggttcgggttacggttacgttcgggtaaccctaccccgtaattcccgtcggtttacccttcgttaacttttccccccgg

SEQ ID NO: 345754 - DNA, 688 bp, Homo sapiens
  misc_feature: GZ8MTXP01BKBOU.45.36.D03.1.454.CMB.2.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctaggtaccaanagaaacctggcaggctccagctcctcatccatgatgcataccaaacgacggggtcccctgggcccgtccccgaagtaccgtaggggttcccggtgggccccgtaggggttcggggtcgtagggggaacctaagggtacgttccactcctccgacccgtcacggcacgccgtggacgtccgtgtagttgttaagttttcgacgtttacgttttacttcgttagtacgtacgtcggtacggttcccggttcccgcccgtaccgtccccgtcgttccgttaccggggtttccggggaccggggggtacccgtacgggggtgggaaggtacggttagggaacggttaacggtaaacggttgggttcgggcgttacggaaccctaacccgtaagttccgttcggttcccttcgttaaccgtttccccg

SEQ ID NO: 345755 - DNA, 532 bp, Homo sapiens
  misc_feature: GZ8MTXP01DY8SU.45.36.D03.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (488)..(488): a, c, t, g, unknown or other
  misc_feature (488)..(488): n is a, c, g, or t
  modified_base (514)..(514): a, c, t, g, unknown or other
  misc_feature (514)..(514): n is a, c, g, or t
  modified_base (525)..(525): a, c, t, g, unknown or other
  misc_feature (525)..(525): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctagtaccaacagaaacctggccaggctcccaggctcctcatccatgatgcatccaacnggggtcccctgggcctcccagacaggttccgnggccaggtgggtctggggacaaggagttcactctcaccgtnagcagcctggagctgatgtattttgctagtttacttctgtcagcgagtccgtttccgccaccgcccgctcgtacgtttcggggcgggggaccgaggggtggaagngttgagacgacgtgttggcttgcacntctgttcttcncgttccc

SEQ ID NO: 345756 - DNA, 642 bp, Homo sapiens
  misc_feature: GZ8MTXP01C5YQ4.45.36.D03.1.454.CMB.2.raw
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (378)..(378): a, c, t, g, unknown or other
  misc_feature (378)..(378): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtactaggctggtacaacagaaccnggccaggcctcccaggctcctnatccatgatgacatccaacgcgggtccctggcctcccaggactacgggttccccgtggcagggtgggtcctagggggacnggagtttccactcctccaccgtcagcacgcctgggacgccgtgagttgtattttgcttagtttacttcgttgtcgtacgtcgtacgtccgttcccgcccgaccgtcccgtccttccgtaaccgggttttccgggggacccgggggggtacccggtaacggggggtcgggttaacgggtacggttaggaacgggtaaccggttaaacggttcgggttacgggtccgttcggtccacccgtacgttccgttcgtttcccgtttccg

SEQ ID NO: 345757 - DNA, 537 bp, Homo sapiens
  misc_feature: GZ8MTXP01AK41B.45.36.D03.1.454.CMB.2.raw
  modified_base (263)..(263): a, c, t, g, unknown or other
  misc_feature (263)..(263): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (482)..(482): a, c, t, g, unknown or other
  misc_feature (482)..(482): n is a, c, g, or t
  modified_base (492)..(492): a, c, t, g, unknown or other
  misc_feature (492)..(492): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatcgatgcatccaacgcggggtccccngggccgtcccagaccgaggttccgnggcccaggtgggtctggggacaagagttcactctcaccgtnagcagcctggngcctgattgtatttgctagtttacttctgtcagcagtccgttccgcctacgcccgctccgtacgttccggggcgggggtacnggggtgaagngttggagacgacgtggngcttgcncctntctcgttctcgcttccc

SEQ ID NO: 345758 - DNA, 604 bp, Homo sapiens
  misc_feature: GZ8MTXP01BSL04.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggcctcctcatccatgatgcatcccaacgcggggtcccctgggccgtccccaggaccgtaggttccgtggcccagggtggggtctggggacaaggagttcactctcaccgtcaggcagctggagcctgattgtatttgtctagtttacttctgtcagtcgtacggtccgttcccgcccgtaccgcccgtcgtccgtaccggtttccggggccggggggtaccgtagggggtggaaggtagttgggaacggacggtaaacggtggttacgggcgttcggcctaccgtaacttcgttcgttctttccgttaacgtttccccg

SEQ ID NO: 345759 - DNA, 641 bp, Homo sapiens
  misc_feature: GZ8MTXP01BFDL9.45.36.D03.1.454.CMB.2.raw
  modified_base (210)..(210): a, c, t, g, unknown or other
  misc_feature (210)..(210): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaacggaaaattgtgttgacacagtctccaggcaccctgtctctgtctccgagggganacagccaccctctcctgcagggccaggtaggagtgtcagtaagtacttaggctggacaanagaaaccnggccaggcctcccaggcctcctcatccatgatgcatcccaacgcgggtcccctgggccgtccccaggaccgtagggtttcccccgnggcgagggtcgggtcgtagggacnggtacgttcactcncaccgtanacgcncgccgtggactctagtagttgttactttgacttacgtttacttgttacgtacgacgtcgtacgtcccgttcccgccgtccggtccgtaccgttccggttaccggggttccgggggaccggggggtaaccggtaagggggtacggacggtaggttacgggaacggtaacggttacggttgggttcgggtcctacggaaccgtacgtcgttccgttcgtttccgtccg

SEQ ID NO: 345760 - DNA, 590 bp, Homo sapiens
  misc_feature: GZ8MTXP01DOX0K.45.36.D03.1.454.CMB.2.raw
  modified_base (264)..(264): a, c, t, g, unknown or other
  misc_feature (264)..(264): n is a, c, g, or t
  modified_base (366)..(366): a, c, t, g, unknown or other
  misc_feature (366)..(366): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctaggtaccaanagaaacctggccaggctcccaggctcctcatccatgatgcatccaacgcgggtccctggcctcccagaccgtaggttccgtgccaggtggtctgggacaagnttcactctcacgtcagcagcctgagctgatgtatttgctagtttacttctagtcagtcgtacgtccggttccgcccgtaccgcccgtccgttccgtaccggtttccgggggccggggggtaccgagggggttgggaacggtacgttaggaacggacggtaaacgtggttacggttcgttcgaaccgtaccgtaacttcgtcgttccttccgttaactttccccg

SEQ ID NO: 345761 - DNA, 604 bp, Homo sapiens
  misc_feature: GZ8MTXP01ENV8I.45.36.D03.1.454.CMB.2.raw
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgtgacacagtctccaggcaccctgtctctgtctccgaggggagacagccaccctctcctgcagggccagtaggagtgtcagtaagtactagggttcnggtaccaanagaaacctggccaggctcccaggcctctcatccatgatgcatccaaacgngggtcccctgggctcccagacaggttccggngccgaggtgggtctgggacaagtacttcactcctaccgaccgtcacgcacgccgtaggacgtcgtagtagttgttattttgtacttagtttacttcgtgtctagtcgtacgtccgttccgcccgaccgtccgtcgtcgtacggttccggggaccgggggtaccgtggggtaggaaggtacgttaggaacggaacggtaacgtgggttacggcgttacgaaccgtacgtaacgttcgttcgttaccttcgttcgttcccg

SEQ ID NO: 345762 - DNA, 535 bp, Homo sapiens
  misc_feature: GZ8MTXP01AE27Y.45.36.D03.1.454.CMB.2.raw
  modified_base (262)..(262): a, c, t, g, unknown or other
  misc_feature (262)..(262): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
  modified_base (440)..(440): a, c, t, g, unknown or other
  misc_feature (440)..(440): n is a, c, g, or t
  modified_base (483)..(483): a, c, t, g, unknown or other
  misc_feature (483)..(483): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccacctctcctgcagggccagtaggagtgtcagtaagtacttaggctggtaccaanagaaacctggccaggctcccagctcctcatccatgatgcatccaaagcgggtccctggccgtcccagacaggttccgtggcccaggtgggtctggggacaaggtacgttcacgtctcaccgtnagcagcctgganctgatgactttgctagtttacttctgtcagcgagtccgttccncctacgccgctcgtacgttcgggcgggggaccaggggtgaagnttggagacgtacgtggttcggcttggccacctctcgtcgttcttcgcgtccg

SEQ ID NO: 345763 - DNA, 571 bp, Homo sapiens
  misc_feature: GZ8MTXP01D1TDC.45.36.D03.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
  modified_base (503)..(503): a, c, t, g, unknown or other
  misc_feature (503)..(503): n is a, c, g, or t
  modified_base (514)..(514): a, c, t, g, unknown or other
  misc_feature (514)..(514): n is a, c, g, or t
  modified_base (551)..(551): a, c, t, g, unknown or other
  misc_feature (551)..(551): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaaccggaaaaattgtgttgacacagtctccaggcaccctgtctctgtctccgagggganacagccaccctctcctgcgagggccaggtaggagtgtcagtaagtacttaggctaggacaacagaactggcaggctccgagctccncatcatgatgacactaccaacgtcgggtccctgggcctacccgaggacctagggttccgtggccgtagggtggggtcgtaggggaccaagggtacgttcactcgtacaccgtnagcgagtcctggacgtcgtgattgtatttgacttagtttacttcgtgtacagcgtacgtcgttaccgccgcgccgctcgtacggttcggggcgggggtacgnggggtggaagngttggacgacgtacgtggttcggcttcggaacacgtntcgtgttcttcgcgttcccg

SEQ ID NO: 345764 - DNA, 598 bp, Homo sapiens
  misc_feature: GZ8MTXP01BM4T1.45.36.D03.1.454.CMB.2.raw
  modified_base (202)..(202): a, c, t, g, unknown or other
  misc_feature (202)..(202): n is a, c, g, or t
  modified_base (403)..(403): a, c, t, g, unknown or other
  misc_feature (403)..(403): n is a, c, g, or t
  modified_base (436)..(436): a, c, t, g, unknown or other
  misc_feature (436)..(436): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtactaggctaggtaccaacagaaacctggaccaggctcccaggctcctcatccatgatcgacataccaacgacgggtcccctgggcccgtcccaggtaccgtacggggttcccgtggccctagggtgggtctggggacagtagttcactctcaccgtnagcagctgacgctgatgtatttgctagtttctntgactagcgagtccgttccgccgaccgcccgtcttcgtaccgggtttccggggccggggggtaaccgtaggggtggaacggtagttcgggaacggttacgtaaacggtggttcggccttggaaccgtacctaagtccgttcgttacttccttcgtttccccg

SEQ ID NO: 345765 - DNA, 655 bp, Homo sapiens
  misc_feature: GZ8MTXP01BOC4V.45.36.D03.1.454.CMB.2.raw
  modified_base (211)..(211): a, c, t, g, unknown or other
  misc_feature (211)..(211): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
  modified_base (641)..(641): a, c, t, g, unknown or other
  misc_feature (641)..(641): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaaccggaaaaattgtgttgacacagtctccaggcaccctgtctctgtctccgagggganacagccaccctctcctgcgagggccaaggtaggagtgtcagtaagtacttaggctaggtaccaacagaaacnggccaggcctacccgaggcctcctnatccatgatgcatccaacgcgggttccctggccgttacccaggacgtacggttccccgtggcgaggtggtccgtaggggacngggtagttcaccgttcgacctaccgtnaacggcacggtcccgtagggacgtcccgttggaacgttggtttaactttttcgggacctttaaggtttttaccttcgttcggttaccgtaaggtccgtacgtcccggtttcccgaccccgacggtcccgtcgttaccgtacccgggtttcgggggcccgggggtacgtaagggggtgacgggtacgttggaacggtacgaacgttggacgggctggaaccactnttccgtgttcttcg

SEQ ID NO: 345766 - DNA, 551 bp, Homo sapiens
  misc_feature: GZ8MTXP01EICCX.45.36.D03.1.454.CMB.2.raw
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (399)..(399): a, c, t, g, unknown or other
  misc_feature (399)..(399): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagacgcgatcgacacgaccggtgctcgatttagctgcgtcacgatctctcttggggaggaactgctcagttaggacccagagggaaccatggaagccccagctcagcttctccttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggaccaggctcccaggctccncatccatgatgcatccaaacgcgggtcccctgggccctccgagaccaggttccgnggccaggtggtcgtgggacaagtagttcactctcaccgtcagcagctganctgatgtatttgctagtttactcgtntcngcgngtccgtccgccgaccgccgtctcgtacggttcgggggacggggacgaggggtgaagagttggacgaacgtagtggttcggcttcggaacctactaacgttctgttccttcgttctcccg

SEQ ID NO: 345767 - DNA, 670 bp, Homo sapiens
  misc_feature: GZ8MTXP01A2QS3.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggagacagccaccctctcctgcaggccagtaggagtgtcagtaagtacttaggctggtaccaacgagaaactggccaggctcccaggcctcctcatccatgatcgacactacccaacgtacggggtcccctgggccgtacccgaggacctaggggttcccgtgggccccgtagggttcggggtccgtgggggaacctaaggtaacgtttccacgttccgtccgacccgttcgaaggcccagcccgtggacgtccgtgtatgtactttgcttagtttacttcgtgtacgtacgcgtacggtccgttaccgcccgtaccgtcccgtccgttaccgttaccgggtttccgggggacccggggggtacccgtagggggttcgggaacggtaggttacgggaacggaccggtaaacggtcgggttacgggccgttcggaacctacgtcgtccgttgttcccttcgttaacctttccccg

SEQ ID NO: 345768 - DNA, 547 bp, Homo sapiens
  misc_feature: GZ8MTXP01DMW5B.45.36.D03.1.454.CMB.2.raw
  modified_base (252)..(252): a, c, t, g, unknown or other
  misc_feature (252)..(252): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccgccagggttccaggcaaggggctgggagtgggtgccctnatttccgaagatggaagtgagaaggcctactcagactccgtgaaggccgcttcaccatctccagagacaattccaagaatgtccttctttttgctaaatgaatagctgagagttgagacacgtctagtctaattctgtgccgagggggacatctatgatcgtggttcgtagtagtaatactaaactactactactcatggggacgtcgtgggacaaagggcctcggtcaccgtctccgcagcctcaccgaaggcccagtcgtccttcccgttgccncctnctcagcncncgtcgg

SEQ ID NO: 345769 - DNA, 567 bp, Homo sapiens
  misc_feature: GZ8MTXP01EXZJK.45.36.D03.1.454.CMB.2.raw
  modified_base (420)..(420): a, c, t, g, unknown or other
  misc_feature (420)..(420): n is a, c, g, or t
  modified_base (545)..(545): a, c, t, g, unknown or other
  misc_feature (545)..(545): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctaggtaccaacagaaacctggccaggctcccaggcctcctcatccatgatgcatccaaacgcgggtcccctgggccgtcccgagaccgtaggttcccgtggcccagggttggggtctggggaaccaaggtacgttcaactctccgacccgtcaggcagcctgganctgatgtatttgtctagtttactctgtcagcgagtccgttccgccgacgcccgctcgtacgtttcggggcgggggtaccgaggggtggaagagttggaagacggaacgtgttcggcttgcacctntctgttcttcgttaagttcccg

SEQ ID NO: 345770 - DNA, 676 bp, Homo sapiens
  misc_feature: GZ8MTXP01CLYLQ.45.36.D03.1.454.CMB.2.raw
  modified_base (202)..(202): a, c, t, g, unknown or other
  misc_feature (202)..(202): n is a, c, g, or t
  modified_base (360)..(360): a, c, t, g, unknown or other
  misc_feature (360)..(360): n is a, c, g, or t
  modified_base (439)..(439): a, c, t, g, unknown or other
  misc_feature (439)..(439): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtaagtacttaggctggtaccaacagaaacctggccaggcctacccaggctcctcactccatgatcgcactccaacgtacgggtcccctgggcccgtacccagaccgtacggtttccggnggacccctagggttggggacttgggggaacctaaggtacgtttccaactccgtacacccgtcaagcacgccgtgggacncgtgtagttgttagtttcgtacttacgtttacgttcgtcgtacgtacgtacggtacggttccgttcccgaccgtaccgtcccgtccgttccggttaccggggttccgggggaccgggggtaccggtaggggtagggaacggtacggttacgggaacggacggtaacgtgggttcggttcgttacggtaaccctaccgttaacgttccgttacgttcctttccgttaaccgtttcccg

SEQ ID NO: 345771 - DNA, 563 bp, Homo sapiens
  misc_feature: GZ8MTXP01CJCQG.45.36.D03.1.454.CMB.2.raw
  modified_base (284)..(284): a, c, t, g, unknown or other
  misc_feature (284)..(284): n is a, c, g, or t
  modified_base (498)..(498): a, c, t, g, unknown or other
  misc_feature (498)..(498): n is a, c, g, or t
  modified_base (544)..(544): a, c, t, g, unknown or other
  misc_feature (544)..(544): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccacggaaaaattgtgttgacacagtctccaggcaccctgtctctgtctccaggggagacagccaccctctcctgcagggccagtaggagtgtcagtaagtacttaggctggtaccaacagaactggcaggctccagctctnatccatgatgcatacccaacgacggggtcccctagggcccgtaccccgagaccgtagggttcccgtggcccctagggtgggtctggggaccaaggacgttcactctacaccgtcagcagcctggagcctgatgtattttcgctagtttactgtgtcagcgtacggtccgttacccgccacgcccgtctcgtacggtttcggggccgggggtacnggggtgaagagttggagacgaacgtggttacggcttcggcaccttntctgttcttcgttcgtccc

SEQ ID NO: 345772 - DNA, 638 bp, Homo sapiens
  misc_feature: GZ8MTXP01DN2HX.45.36.D03.1.454.CMB.2.raw
  modified_base (210)..(210): a, c, t, g, unknown or other
  misc_feature (210)..(210): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaccggaaaaattgtgttgacacagtctccaggcaccctgtctctgtctccgagggganacacgccaccctctcctgcagggccaggtaggagtgtcagtaagtacttaggctaggtaaccaacgagaaacctggccaggcctcccaggcctcctcatccatgatgacactccaaacgtcgggtccccnggccgtcccaggtacctacggggtttccccgngggctagggttggggtcctagggggaactaagggacgtttccaacttcctaccgaccggtcaacggtccacggtcccgtgggacgccgttaggaattggtacttttggacttacgtttactttcgtcgttacgacgtcgtacggtccgttcccgccgtaccgccgtcctaccgtaccgggtttccgggggccgggggacgtaaggggtcggagacgttggacgacggttagttggttacgcttcggctacgattccgtgttccgtc

SEQ ID NO: 345773 - DNA, 700 bp, Homo sapiens
  misc_feature: GZ8MTXP01EM6HH.45.36.D03.1.454.CMB.2.raw
  modified_base (209)..(209): a, c, t, g, unknown or other
  misc_feature (209)..(209): n is a, c, g, or t
  modified_base (280)..(280): a, c, t, g, unknown or other
  misc_feature (280)..(280): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaacggaaaaattgtgttgacacagtctcaggcaccctgtctctgtctccgagggganacagccacctctcctgcgagggccaggtaggagtgtcagtaagtacttaggctacggtacaagagaaaccnggaccaggcctacccgaggcctcctcactccatgactgcactaccaacgacggggtccctgggccgtacccgaggtaccgtacggggtttccccggtgggacgtaggggttcgggggtcgtaacgggggaactaacgggtacgtttaccaaccgttccgtaccgtacccgggtacaacggccacggtccggtagggacgtccgtaggtacttgttacgtttgacttacgtttactcgtcgtacgacgtccgtacgtcccgttcccgcctaccggccgttaccgtccggttaccggggttccggggggaccggggggtaccgtaagggggtacggttagggagttacgggtaacggaacggttaacgggttgggttcggaaccgtcgtaaccgtccgtattcccgttcgtttccgtaaccg

SEQ ID NO: 345774 - DNA, 554 bp, Homo sapiens
  misc_feature: GZ8MTXP01BYCBC.45.36.D03.1.454.CMB.2.raw
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (281)..(282): a, c, t, g, unknown or other
  misc_feature (281)..(282): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (528)..(528): a, c, t, g, unknown or other
  misc_feature (528)..(528): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaacggaaaattgtgttgacacagtctccaggcaccctgtctctgtctccgaggggagacacgccacctctcctgcagggccaggtaggagtgtcagtaagtactagctggacaanagaacnggccagcnccagctcnntcatgatgcactccaacgcgggtcccnggctccagacaggttccggngcgnggtggngngganagtntcactcncaccgtnacgcacgctggactctagtagttgtatttgacttacgtttctcgtcgtacgagtcgacgtccgtccgccgaccgccgtctccggtacggtccgggggacggggacgtaggggtgaaggtgttacggaacgacgtaacggtggttcggcgttacgaacctaccgtnttccgtcgttcttccgttccgttccg

SEQ ID NO: 345775 - DNA, 687 bp, Homo sapiens
  misc_feature: GZ8MTXP01EDTNV.45.36.D03.1.454.CMB.2.raw
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccaggtaggagtgtcagtaagtacttaggctggtaaccaanagaaacctggaccaggcctcccgaggcctcctcatccatgatgacatccaacgacgggtccctggccgtacccaggaccgtagggtttcccccggnggacgtagggtcgggtacgtaacggggaactaaggtacgtttaccaccttcctaccgaccgtcacgcgtacggtccgtagggacgtccgtagtagttaggttatttcgacgtttacgtttacttcgttcgttacggtacgtcgtaccggttcccgttcccgacccgtaccgtcccgtaccgttccgttaccggggtttccgggggaccggggggtaccggtaagggggtcgggaaggtacggttacgggaaacggtaacggttaacggttcgggttacgggtcgtcgaaccgtaccgtacgttcgttcgtttccgtcg

SEQ ID NO: 345776 - DNA, 513 bp, Homo sapiens
  misc_feature: GZ8MTXP01D0O2K.45.36.D03.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (440)..(440): a, c, t, g, unknown or other
  misc_feature (440)..(440): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaaattgtgttgacacagtctccaggcaccctgtctctgtctccagggganacagccaccctctcctgcagggccagtaggagtgtcagtaagtacttaggctggtaccaacagaaacctggcaggctcccaggctcctcatccatgatgcatccaaacngggtccctggcctcccagacnggtccgngccaggtgggtcnggggacagngttcactctcaccgtcagcagcctggagctgattgtatttggcttagtttactctgtcagcacgtcgtccgccacgtccnctcacggttcggcgggggtaccnggggtgngagttggaagacgagtgnggcncgcacntgtcttctcncgtcc

SEQ ID NO: 345777 - DNA, 630 bp, Homo sapiens
  misc_feature: GZ8MTXP01D67S2.45.36.D03.1.454.CMB.2.raw
  modified_base (266)..(266): a, c, t, g, unknown or other
  misc_feature (266)..(266): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcaagtaagtacttaggctggtaccaanagaaacctggccaggctccagctcctcatccatgatgcactccaaacgcgggtcccctgggccgtccccaggacctagggttcccgtgggcccagggttggggtcgtgggggaaccaagggtacgtttccgacttcctccgaacccggtcaacggcacgcccgtgggacgtccgtgacttgtattttggacttacgtttacttcgtgtacagtcgtacgtccgttccgccgacgcccgtcgttccgtaccggtttccggggccggggggtaccgtagggggtcgggaagtagttagggacgacggtaaacgtgggttcggcttcggcctaccgtaacgttcgtgttccttccttcgtttccccg

SEQ ID NO: 345778 - DNA, 813 bp, Homo sapiens
  misc_feature: GZ8MTXP01E0YLK.45.36.D03.1.454.CMB.2.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctgacanagaacngcagctccagctccncatcatgatcgcactccaaacgtacggggtcccctgggcccgtaccccgaagtacccgtacggggtttccccgtgggaccccgtagggttcgggggtacgtagggggaacctaaagggtacgtttccaacctttccgtaccgtaacccggtcaacgggtcccaacgggtcccgttaggggaacggtcccgttaggtaacgtttggtttaaacgttttttcgggtacctttaaacgggttttttaccctttaccgtttacggttcccgtaaacggtcccggttaaaccgggttccccgggtttaccccggccccggttaacccggccccgtccgttacccggttacccggggttttcccggggggacccggggggggtaacccgtaacggggggttggggaaaggtaacgggttacggggtaaacgggaacccggtaaaccgggttcggggttacgggttcccgttcggaaccccggtaaccctaacggtttcccggttcggtttacccgtttccgttaaccggtttcccccg

SEQ ID NO: 345779 - DNA, 472 bp, Homo sapiens
  misc_feature: GZ8MTXP01BNPK9.45.36.D03.1.454.CMB.2.raw
  modified_base (202)..(202): a, c, t, g, unknown or other
  misc_feature (202)..(202): n is a, c, g, or t
  modified_base (432)..(432): a, c, t, g, unknown or other
  misc_feature (432)..(432): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(472): a, c, t, g, unknown or other
  misc_feature (463)..(472): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccacctctcctgcagggccagtaggagtgtcaacaggttccgtggcagtgggtctgggacagagtcactctcaccgtcagcagcctggagcctgatgattttgctagtttacttctgtcagcagccgttccgcacgccgctcacgtttcgggcggggggtaccaggggtgagatgagacgaactgtggctgcaccatctgtcttcatcttcccgccatctgatcgntcgcgtctgagcggcggngcgngcgcngngnnnnnnnnnn

SEQ ID NO: 345780 - DNA, 628 bp, Homo sapiens
  misc_feature: GZ8MTXP01DMYRB.45.36.D03.1.454.CMB.2.raw
  modified_base (211)..(211): a, c, t, g, unknown or other
  misc_feature (211)..(211): n is a, c, g, or t
  modified_base (280)..(280): a, c, t, g, unknown or other
  misc_feature (280)..(280): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaaccnggccaggctacccaggctcctnatccatgatcgacatccaacgacggggtcccctgggccgtcccaaggacgacggtttccccgngggcgtaggtcggggtccgtaggggaactggtacgtttccacttcctaccgaccgtcgaacgccgacgtcccgtgggacgccgtagaacttgtattttgacttagtttacttcgttgtcgtagtcgtacgtccgttcccgcccgaccgcccgtccgtccgtaccggtttccgggggccgggggtaccgaaggggtggaggtagttacggacggacgaacgttggttacggcgtcggccgactattcgttcgttcgtttaaccg

SEQ ID NO: 345781 - DNA, 764 bp, Homo sapiens
  misc_feature: GZ8MTXP01A7RXE.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccacctctcctgcagggccagtaggagtgtacagtaagtacttaggctggtaccaacagaaactggccaggctcccgaggctcctcatccatgatcgacactcccaaacgtcggggtcccctgggggccctaccccgaaggtaccgtacggggtttccccggtgggcccgtaaggggttcgggggtaccgtaggggggaaccctaagggtaacggtttccaaaccgttcctacccgtaaccccgggttcaacggtccgaacgggtcccgttaggggacggtcccgttaggaacgtttggttaaagttttttcggactttaacgggtttttaccttcgttacgttcgtaacggtccgtaacgggttccccggtttccccgcccgtacccggtcccgtcccgttccggttacccgggttttccggggggaccgggggggtaacccgtacggggggtggggaaggtaacggttagggaacggttaaacggtaaacggttgggttcgggcgttcggaacctaacccgtgttccgttcggttacctttcgttaacctttccccg

SEQ ID NO: 345782 - DNA, 516 bp, Homo sapiens
  misc_feature: GZ8MTXP01EKN18.45.36.D03.1.454.CMB.2.raw
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggatgtcagtaagtacttaggctaggaccaanagaaacnggccaggcnccagctccncatccatgatgcatccaaancgggtccctggccgtccagacaggtccgtggcccaggtgggtctggggacaagagttcactctcaccgtcagcagctgacgctgatgtatttgctagtttactctgtctagcgtagtccgttccgccaccgccgctcgtacgttcgggcgggggtaccgngggngaagngngagacgagtgngcngcacnctctcgttctcttctccg

SEQ ID NO: 345783 - DNA, 583 bp, Homo sapiens
  misc_feature: GZ8MTXP01DFHFB.45.36.D03.1.454.CMB.2.raw
  modified_base (237)..(237): a, c, t, g, unknown or other
  misc_feature (237)..(237): n is a, c, g, or t
  modified_base (264)..(264): a, c, t, g, unknown or other
  misc_feature (264)..(264): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcttgggttttggggggaagaggaagactgacggtcctcccaggagttcaggtgctgggcaccttggggcacggggggaggtgtgtcacaagatttgggctctgggcaccgtgggcagtggggggaggcgttgtccagcctgggaggtccctgagactctcctgtgcagcctctggattcctccctnagttaactttggttccacgtgggtccncaggttccaggcaaggggctggagtgggtggccctcatttccgaagatggaagtgagaaggcctactcagactccgtgaacgggccgcttcaccatctccagagaccaattccaagaatgtaccttnttttgactaaatgaatagctgagagttgagacacgtctgtctatttctgtgccgtaggggacatcgtatgattcgtggttcgtagtgtaaatctaaactactaaccttcctctagttcggaacgttcgtagggggtacaaacggggccttacgggtccaccggttcctcccggcacgtccttcccgaacccg

SEQ ID NO: 345784 - DNA, 592 bp, Homo sapiens
  misc_feature: GZ8MTXP01CBTQA.45.36.D03.1.454.CMB.2.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctaggtaccaacagaaacctggccaggctcccaggctcctcatccatgatgcactacccaacgacggggtcccctgggcccgtcccaagtaccgaggttcccgtggcccaggtgggtcgtggggacaggtacgttcactcnccaccgtcagcacgccgtggacgctgatgtattttgacttagtttacttctgtcagcgtacgtccgttccgccgaccgtcccgtccgtccgtaccggtttcggggccgggggtaccgtagggggtggaaggtagttggacgacggtaaacgtggttggcgttcggcacctaagtctcgttccttcgaactttccccg

SEQ ID NO: 345785 - DNA, 607 bp, Homo sapiens
  misc_feature: GZ8MTXP01AD3X1.45.36.D03.1.454.CMB.2.raw
  modified_base (211)..(211): a, c, t, g, unknown or other
  misc_feature (211)..(211): n is a, c, g, or t
  modified_base (281)..(281): a, c, t, g, unknown or other
  misc_feature (281)..(281): n is a, c, g, or t
  modified_base (361)..(361): a, c, t, g, unknown or other
  misc_feature (361)..(361): n is a, c, g, or t
  modified_base (555)..(555): a, c, t, g, unknown or other
  misc_feature (555)..(555): n is a, c, g, or t
  modified_base (588)..(588): a, c, t, g, unknown or other
  misc_feature (588)..(588): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctggtaccaacagaaaccnggaccaggcctcccgaggcctcctcatccatgatgcatccaacgtcgggtccctgggcctccgagacgtcggttccccgnggcaggtgggctaggggactggtacgttccacgttcctaccgaccgtcaagcacggccgtagggacgcctagtagtgttattttcggacttacgtttacttcgttgtcgagtcgtcggtccgttcccgcccgtaccggcccgtccgtccgtaccggttccgggggaccgggggtaccgaaggggtcgggagtgnggaggaacgttacgttggttcgctcggcacgtnttcgttcgttcgtttaacg

SEQ ID NO: 345786 - DNA, 681 bp, Homo sapiens
  misc_feature: GZ8MTXP01B4YBL.45.36.D03.1.454.CMB.2.raw
  modified_base (282)..(282): a, c, t, g, unknown or other
  misc_feature (282)..(282): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggagcgttgtccagccgtgggagtccctgagactctcctgtgcagcctcgtggatcctccctntagttaacctttggttccacgttcggggtcccnccaggttcccagggcgaagggggctgggagtgggtcgccctntattccggaagtcgtaggaagtgagaacggcctaaactcgaagacctccggtaggaaacggggccctacgttaccaccctatctacccgaagacgaactaacttaacccgaaagtaacttacgttaccttacttttacgaactaaacgtaggtaaatacggtccctaggtaagtaggtttaggacggtaaaccgtaacgttcgttacgttacctttaagtttccgtggttcgggacccggttaaggggggtaacctagttaccgttaagttcggtaaggttcgttgggtttacgtaggttagttaacgttaaccgttaaacccg

SEQ ID NO: 345787 - DNA, 607 bp, Homo sapiens
  misc_feature: GZ8MTXP01DHS72.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
  modified_base (535)..(535): a, c, t, g, unknown or other
  misc_feature (535)..(535): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcaggccagtaggagtgtcagtaagtacttaggctaggtaccaanagaaactggccaggctccagctctcatcatgatgcatccaaagcgggtcccctggccgtcccagtaccaggttccgnggccaggttgggtctggggacaagagttcactccgtacaccgtcagcagccctggactccgtgtatgtaagttttcgccttaggtttaccttcgttggttacacgggtacctaacggtcccgtttcccgacccgtaccggcccgtcttccgtaaccggtttccgggggaccgggggacccgtagggggcggtaagnggttaggacgttaacggtaaacgtgggttacgggcttacgaaccaccttgtcgttcgttcttcgcgttcccg

SEQ ID NO: 345788 - DNA, 591 bp, Homo sapiens
  misc_feature: GZ8MTXP01ANNHA.45.36.D03.1.454.CMB.2.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
  modified_base (568)..(568): a, c, t, g, unknown or other
  misc_feature (568)..(568): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggtgtgtcacaagatttgggctctgggcaccgtgggcagtgggggagcgttgtccagcctgggagtccctgagactctcctgtgcagcctctggattctccctnagttaactttggttccactgggtccnccaggttccaggcaaggggctggagtgggtggccctnattccgaagntggaagtgagaggcctactcagactccgtagaagggcccgcttcaccgatcctcagagaccaattccaaagactgtcccttnttttgactaaatgaatagcctagagagttgaggactacgtctgtcttattctgttagcccgaggggtactagtacgttagtaggtagtccgttggttcgtagttagtaatactaactactactactcgattgggtacttcggtacgggacgaacgggttccttcggtccaccgtccgtcccgngaccgtccgttccgaaccccggg

SEQ ID NO: 345789 - DNA, 602 bp, Homo sapiens
  misc_feature: GZ8MTXP01DUZPR.45.36.D03.1.454.CMB.2.raw
  modified_base (547)..(547): a, c, t, g, unknown or other
  misc_feature (547)..(547): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctaggtacaacagaaacctggaccaggctcccaggctcctcatccaatgatcgacactccccgaaacgacggggttccccctgggcccgtccccaaggacctacggggttcccgtgggccctaggggtggggtctgggggaaccaagggtacgtttcaacctcttcccgaccgttcacggcacgcccgtggacgccgtgatgtagttttgactagtttacttctcgtcagcgacgtcgttccgccgaccgccgtctcgaccggtttccgggaccgggggaccgagggtggaagngttcggagacgacgtgttcggcgttcgcactaactcgtgttctcttaacttcccg

SEQ ID NO: 345790 - DNA, 579 bp, Homo sapiens
  misc_feature: GZ8MTXP01DG0WJ.45.36.D03.1.454.CMB.2.raw
  modified_base (208)..(208): a, c, t, g, unknown or other
  misc_feature (208)..(208): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagacgcgatcgacacgaccggtgctcgatttagctgcgtcacgatctctcttggggccctggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaanagaaaccnggccaggcctcccaggcctcctnatccatgatgcatccaagcgggtccctggcctcccagacaggttccccgnggcnggtggtctagggacngtntcactctacacgtnagcagcgtggcgcgtgtagttgtatttcgcttagtttacttctcgtcgtacgtcgtacgtccgttcccgccgccgcccgtaccgttccgtaccggttccggggccgggggtaccgtaaggggtcggaggtacgttggacggaacggttacgttggttacggcgtcgcctaccgtcgttcgttcgttccgttcg

SEQ ID NO: 345791 - DNA, 633 bp, Homo sapiens
  misc_feature: GZ8MTXP01BJEQT.45.36.D03.1.454.CMB.2.raw
  modified_base (200)..(200): a, c, t, g, unknown or other
  misc_feature (200)..(200): n is a, c, g, or t
  modified_base (345)..(345): a, c, t, g, unknown or other
  misc_feature (345)..(345): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggganacagccacctctcctgcagggccagtaggagtgtcagtaagtacttaggctggtaccaacagaaacctggccaggctcccaggctcctcatccatgatgcatccaacgacgggtcccctggccgtcccagaccaggtttcccggnggcccgtagggtgggtcgtggggactaaggtacgttccactcctaccgaccgtcacggcacgtccgtggacgtccgtaggtagttgttagtttcgtacgttagtttacttcgtgtacgagcgtacgtccgttcccgacccgtccgcccgtccgtccgtaccggttccgggggaccgggggtaccgacgggggtggaacggtagttacgggacggaacggtaacggttggttcgggccgttcggaacctaccgtaacgttccgttcgttccttccgttaaccgttcccg

SEQ ID NO: 345792 - DNA, 617 bp, Homo sapiens
  misc_feature: GZ8MTXP01DD5WI.45.36.D03.1.454.CMB.2.raw
  modified_base (603)..(605): a, c, t, g, unknown or other
  misc_feature (603)..(605): n is a, c, g, or t
  modified_base (607)..(617): a, c, t, g, unknown or other
  misc_feature (607)..(617): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaacggaaaattgtgttgacacagtctccaggcaccctgtctctgtctccgaggggagacacgccaccctctcctgcagggccaggtaggagtgtacaaacgtgggttccgtggcgtagggtgggtcgtgggacagtacgtcactctcaccgtcacgcacgccgtggacgtcctggtatgttattttcgctttacgttttactcttagtcagtctacggtccccgttcccgcacgcccgtcgtccgttacggtttccgggggacgggggtaaccgagggggtaggacgaggtgggaaacgtacggtaacgtgggtcggcgtacgaccctaccgtattccgttcgttccttaccgtaacttccccgttaccccgacgttacttaccgttaactcggtactccggtcgtcggtacgggaccggtcggggtaccgagggaccggaacgggcgacaagttcggnnngnnnnnnnnnnn

SEQ ID NO: 345793 - DNA, 568 bp, Homo sapiens
  misc_feature: GZ8MTXP01AKY9F.45.36.D03.1.454.CMB.2.raw
  modified_base (518)..(518): a, c, t, g, unknown or other
  misc_feature (518)..(518): n is a, c, g, or t
  modified_base (537)..(537): a, c, t, g, unknown or other
  misc_feature (537)..(537): n is a, c, g, or t
  modified_base (552)..(552): a, c, t, g, unknown or other
  misc_feature (552)..(552): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggagacagccaccctctcctgcagggccagtaggagtgtcagtaagtacttaggctggtacaacagaaacctggccaggctcccaggctcctcatccatgatgcatcccaaagtcgggtcccctggccgtccccagaccgtaggttcccgtggccctagggtcggggtcctgggggacctaagggacgtttccacttcctcacccggtcagcagccctggacgctgatgtatttgctagtttacttctgtcagctacgtccgttccgcccacggcccgcgttccgtacggtttcgggccgggggaccgtaggggtggaagngttggagacgaacgttggnggcttacggcacctntctgttctcgcgtccg

SEQ ID NO: 345794 - DNA, 622 bp, Homo sapiens
  misc_feature: GZ8MTXP01DGPYX.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaccaanagaaacctggcaggctccagctccnatcatgatgcactacccaacgacggggtcccctgggccgtcccgaagaccgtacgggttccgnggtcccagggttggggtcgtaggggacaagacgttcacttctacgaccgtcagcgacgccgtggacgcctgacttgtagtttgacttagtttacttcgtgtcgacgtcgtacgtccgttcccgccgaccgtcccgtccgttccgtaccggtttccgggggaccggggggtaccgtagggggtcgggaaggtacgttagggaacggacgtaaacgtgggttacggcgttcggcctacctaacgttcgttcgttcttcgttaactttccccg

SEQ ID NO: 345795 - DNA, 700 bp, Homo sapiens
  misc_feature: GZ8MTXP01B7UPM.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (672)..(672): a, c, t, g, unknown or other
  misc_feature (672)..(672): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctaggtaccaanacgaaactggccaggctccaggctccncatccatgatgcactacccaacgacggggtcccctgggccgtaccccgaggaccgtacgggttcccggtggcccgagggttggggtcgtacgggggactaaggtacgtttccgaccttccgtacccgtaacccggtcgaacggcctaacggtccccgttagggaccggtcccgttaggaatttggttaacgttttttcggacgtttaacggtttttaccttccgttgggtactacggtcgtacggtcccgggtttcccacccgtccgcccgtccttcggtacccgggtttcgggggaccggggggtaccgtagggggtgggaaggtagttggggaaacggacgggtaaactcggggttacgggcttcggaaccacccgttntccgttcgttccttccgttcgttccccg

SEQ ID NO: 345796 - DNA, 789 bp, Homo sapiens
  misc_feature: GZ8MTXP01CLG2S.45.36.D03.1.454.CMB.2.raw
  modified_base (210)..(210): a, c, t, g, unknown or other
  misc_feature (210)..(210): n is a, c, g, or t
  modified_base (278)..(278): a, c, t, g, unknown or other
  misc_feature (278)..(278): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccaggtaggagtgtcagtaagtacttaggctggtacaacagaaacnggccaggctcccaggctcctcatccatgatgacataccgaacgtacggggtcccctgggccgtacccaaggaccgtaggggtttccccccgtggggctaaggggtcggggtaccgtacggggggaactaagggtacgtttacccaacttcccgtaccgaaccccggttcaacggtacccgacggtaccccgttgggggaaccgtcccgttaggtaacgttcgggttaaacttttttggggacctttaacgggttttttaaccctttcgtttacgggttcctaacgggtccgttaacggtccccggtttccccgaccccgaccggtcccggtccgttaccgtaacccggggttttcccgggggacccgggggggggtaccgtaacggggggttacggggttaacgggaacggttagggaaacgggaaccggggttaaaacggttcggggttacgggggccgttacgggcccgtaacccgtaagttcccgtttcggtttcccgttttaacccg

SEQ ID NO: 345797 - DNA, 748 bp, Homo sapiens
  misc_feature: GZ8MTXP01D4U15.45.36.D03.1.454.CMB.2.raw
  modified_base (210)..(210): a, c, t, g, unknown or other
  misc_feature (210)..(210): n is a, c, g, or t
  modified_base (438)..(438): a, c, t, g, unknown or other
  misc_feature (438)..(438): n is a, c, g, or t
  modified_base (728)..(728): a, c, t, g, unknown or other
  misc_feature (728)..(728): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaaccggaaaattgtgttgacacagtctccaggcaccctgtctctgtctccgagggganacacgccaccctctcctgcgaggccaggtaggagtgtcgaagtaagtacgttagggctacggtaaccaacgaaacggaaacccgtcggaccgaacgggcccttacccgaagggtcccttaccccgtacaactcccgaagtcgaattcggacctaacgtaccccgaaaaccggtccggggttcccctcgggacccgttaccccaaggtaccggtacgggtttccccggngggacgtaggggttcggggtcgtaacgggggactaacgggtacgtttccaaccgttcctacccgacccggtcgaacgccacggtcccgtagggacgtcctagtacgttgttatttcgacgttagtttacgttcgtacggtcgaacgtcgtaccgtccgttcccgccgccgtcccgtcttaccggtccgggtttccgggggaccggggggttaccgaagggggttggaaggtacgttacgggaaacggtaccggttaacggttgggttcggaaccgttgaacccgtaacgnttcgtcgttcgtttaacccg

SEQ ID NO: 345798 - DNA, 607 bp, Homo sapiens
  misc_feature: GZ8MTXP01BRIG8.45.36.D03.1.454.CMB.2.raw
  modified_base (211)..(211): a, c, t, g, unknown or other
  misc_feature (211)..(211): n is a, c, g, or t
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtaagtacttaggctaggtaccaanagaaacnggccaggctccaggctccncatccatgatgcatccaacgcgggtccctggcctccagacgtacggttccccgnggcaggtcgggtctaggggacnggtagttccactctcaccgtcacgcagccgtggactccgtagattgtattttgacttagtttacttcgtgttcgaggtccgtacgtcccgttacccgcccgaccggtcccgtccgttccgtaccggtttccgggggacgggggtaccgaagggggtcggaggtacgttggaacggtacgttaacggttggacggtcgtagcccgaccgtacgttccgttcgttccgttccg

SEQ ID NO: 345799 - DNA, 582 bp, Homo sapiens
  misc_feature: GZ8MTXP01C5EWK.45.36.D03.1.454.CMB.2.raw
  modified_base (418)..(418): a, c, t, g, unknown or other
  misc_feature (418)..(418): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctaggtaccaacagaaacctggccaggctcccaggctcctcactccatgatcgcactaccaacgcgggtcccctgggccgtcccgagaccgtacgggttccgtggccccgagggtgggtcgtggggacaaggtagttcactctcgaccgtcagcacgccgtggacnctgacttgatttgcttagtttctgtgtcagtcgacggtccgttcccgccgtaccgccgtacctcgtaccggttccgggggacgggggtaccngggggtcggaagnggttaggagcgtaacgtggttaggcttaggccacgtgttctgttcttaacgctttcccg

SEQ ID NO: 345800 - DNA, 575 bp, Homo sapiens
  misc_feature: GZ8MTXP01AV0PJ.45.36.D03.1.454.CMB.2.raw
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (553)..(553): a, c, t, g, unknown or other
  misc_feature (553)..(553): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttagggctggtaccaacagaaacctggccaggctcccaggctcctcatccatgatgcatccaaacgngggtcccctgggccgtcccagacaggttccgnggcccaggtgggtctgggacagagttcactctcacgtcagcagcctggacnctgatgtatttgctagtttacttctgtacagcgtacggtccgttcccgccgtaccgcccgtcttccgtaccgggtttcgggggaccgggggtacctgggggttggaaggtacgttgggaacgacggtaacgtgggttcgggcttcggcaccgttnttctcgttcttcgttccgtccg

SEQ ID NO: 345801 - DNA, 555 bp, Homo sapiens
  misc_feature: GZ8MTXP01EETDF.45.36.D03.1.454.CMB.2.raw
  modified_base (263)..(263): a, c, t, g, unknown or other
  misc_feature (263)..(263): n is a, c, g, or t
  modified_base (397)..(397): a, c, t, g, unknown or other
  misc_feature (397)..(397): n is a, c, g, or t
  modified_base (502)..(502): a, c, t, g, unknown or other
  misc_feature (502)..(502): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtagagtgtcagtaagtacttaggctaggtaccaanagaaacctggccaggcctcccaggctcctcatccatgatgacatcccaaacgcggggtcccctgggcctcccgagaccgtagggttcccgtggcccagggtgggtctggggacaaggagttcactctcaccgtnagcagcctgacgctgatgtatttgtctagtttacttctgtactagtcgtacggtcgttcccgccgaccgcccgcgtcgtacggtttccgggccgggggtaccggngggtggaagtagngacggacgagtggngcgcgcactntctcgttctcttcgtc

SEQ ID NO: 345802 - DNA, 543 bp, Homo sapiens
  misc_feature: GZ8MTXP01A3WST.45.36.D03.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctnatccatgatgcatccaaacngggtcccctggctccagcaggttccgngcnggtggcnggacaagagttcactctcaccgtnagcagctgngctgatgtatttgtctactttacttctgtctagcgacgtcgttccgcccgaccgccgccgtccgtacgttccgggtccgggggaccggacgggtgggaaggagttaggagacggaacgtgttggttcgttcgcactaacgtcgtcgttcttcgttcgtccg

SEQ ID NO: 345803 - DNA, 526 bp, Homo sapiens
  misc_feature: GZ8MTXP01AFXGB.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggcgtcccagacaggttccgtggccaggtgggtctggggacaagagttcactctcaccgtcagcagcctggagcctgatgattttgctagtttacttctgtcagcagcgttccgccacgccgctcactttcgggcgggggtaccgaggggtggaaagtgagacgaacgtacgtggcgttgcgaaccactctgtcttctcttcttcccg

SEQ ID NO: 345804 - DNA, 670 bp, Homo sapiens
  misc_feature: GZ8MTXP01DLZW5.45.36.D03.1.454.CMB.2.raw
  modified_base (288)..(288): a, c, t, g, unknown or other
  misc_feature (288)..(288): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccacggaaaattgtgttgacacagtctccaggcaccctgtctctgtctccgaggggagacagccaccctctcctgcagggccaggtaggagtgtcagtaagtacttaggctggaccaacagaaacctggccaggctccgaggctccncatccatgatcgcactacccaaacgtacggggttcccctgggcccgtaccccgaggaaccgtacggggttccggtgggccccgtaggggttcggggtctagggggacctaaggtacgtttcaaccgttccgtaccaacccgtcgacgcgacgcccgtaggacgtccgtagtattggttattttcgcttagtttacttcgtgtctacgtcgtacggtccgttcccgcccgtaccggccgtaccgttcgtaaccgggttttccgggggaccggggggtacccggtacgggggttagggaaggtacgttagggaacggaacggtaaacgttgggacggttcgttcggcctaccgtaattcgtcgttccttaacttcgtttccccg

SEQ ID NO: 345805 - DNA, 552 bp, Homo sapiens
  misc_feature: GZ8MTXP01BH49L.45.36.D03.1.454.CMB.2.raw
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacncggggtcccctgggccgtccccagaccagggttccgtggcccaggtggggtctggggacaagagttcactctcaccgtnagcagcctggagctgatgtatttgctagtttacttctgtcagcgacgtcgttcccgccgaccgcccgctccgaccgtttcggggccgggggtaccgaggggtggaagtagttggacgacgacgtggcggcgttgcacgtaatcgtgttcttcttcgttcccg

SEQ ID NO: 345806 - DNA, 631 bp, Homo sapiens
  misc_feature: GZ8MTXP01EO362.45.36.D03.1.454.CMB.2.raw
  modified_base (209)..(209): a, c, t, g, unknown or other
  misc_feature (209)..(209): n is a, c, g, or t
  modified_base (285)..(285): a, c, t, g, unknown or other
  misc_feature (285)..(285): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (430)..(430): a, c, t, g, unknown or other
  misc_feature (430)..(430): n is a, c, g, or t
  modified_base (566)..(566): a, c, t, g, unknown or other
  misc_feature (566)..(566): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaccggaaaattgtgttgacacagtctccaggcaccctgtctctgtctccgagggganacacgcccaccctctcctgcgagggccagtaggagtgtcagtaagtactaggctaggtaaccaagaacgaaaccgnggaccaggcctacccgaggcctcctcactccatgatgcactccaacgtccgggtccctggcctccgagacgtacgggtccccgnggctaggtggtcgtaagggacnggtagtccactctcgaccgtgacgacacgtcctgggacncctagaacttggttactttgacttacgtttacttcgttgtacgtagtccgtacggcccgttccccgccgtacccggccgtaccttccgtaaccggggtttcgggggccgggggtaccgaagggggtggacgtaggnggaacgtaaggttacgttgggttcggaacgtcggtaaccaactcgttcgttcgtttcgttaaccg

SEQ ID NO: 345807 - DNA, 656 bp, Homo sapiens
  misc_feature: GZ8MTXP01CGQD8.45.36.D03.1.454.CMB.2.raw
  modified_base (202)..(202): a, c, t, g, unknown or other
  misc_feature (202)..(202): n is a, c, g, or t
  modified_base (432)..(432): a, c, t, g, unknown or other
  misc_feature (432)..(432): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccaccctctcctgcagggccagtaggagtgtcagtaagtactaggctggtacaacagaactggcaggctcccaggctcctcatccatgatgaccactaccgaaacgtcgggggtcccctgggcccgtaccccgaggtaccgtacgggttcccggtggacccgtagggtgggggtctaggggacaagggtacgttccactcctcaccgtcacgcacgccgtggacncgtgattggtattttgcttagtttacttcgtgtcagtcgacggtccgttcccgaccgaccggtcccgcgttccgtaccgggtttccggggggaccgggggtaccgtagggggtgggaaaggtcggttggggaaacggacccgggtaaacggttgggttcggggcccttagggtaacccacccttaagttcccgttcggttacctttcccttaacggtttccccg

SEQ ID NO: 345808 - DNA, 671 bp, Homo sapiens
  misc_feature: GZ8MTXP01CS33H.45.36.D03.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcagggccaggtaggagtgtcagtaagtacttaggctggtaccaanagaacctggcaggctcccagctcctcatccatgatgcactacccaacgcgggtcccctgggccgtccgagacgtacggttccgtggccgtagggtgggtcgtaggggacctaaggtacgttccacgtcctaccgaccgtcacggtcgacgcccgtaggacgtccgtagtacgttgttagtttttcgactttaggttttaccttcgttacgtacgtacggtccggtacggtcccggttccccgacccgtacccggtccccgtccgttaccggtaccgggtttcccgggggaccggggggtaacccgtaggggggtcggaaggtacggttaggtaacggacggtaaacggtggttacgggcgttcggaaccaccctaagttcgttacgttcctttcgttccgtttcccg

SEQ ID NO: 345809 - DNA, 781 bp, Homo sapiens
  misc_feature: GZ8MTXP01CO7S3.45.36.D03.1.454.CMB.2.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacacgcccaccctctcctgcgagggccagtaggagtgtcaagtaagtacttaggctaggtaaccaacagaaacctggaccaggcctcccgaggcctcctcatccatgatcgacactaccaaacgtcgggtcccctgggccctacccgaggaccgtacgggttccggtagggcccgtaggggttggggtcgtagggggaacctaaagggtaacgtttccaacgttcccgtaccgtaccccgggtcaacggcccgtaacggcccgttaggggaaccgtcccgttagggtaactttcgggttaaatttttttcggaccgtttaacggtttttaccttccgttgtacccgtaaggtcccggttaacgggttccccggtttaccccgccccgtaccggtccccggtacccttccggtaacccggggtttcccggggggacccgggggggtacccgtaacggggggtgggtaacggaggttaccgggaaacgaaccgggtaaaccgttgggttacgggttccgttacggaacccgaaccttcgttccgttcgttacccgtttaaccttaaccgttttcccccg

SEQ ID NO: 345810 - DNA, 745 bp, Homo sapiens
  misc_feature: GZ8MTXP01A6CFI.45.36.D03.1.454.CMB.2.raw
  modified_base (210)..(210): a, c, t, g, unknown or other
  misc_feature (210)..(210): n is a, c, g, or t
  modified_base (278)..(278): a, c, t, g, unknown or other
  misc_feature (278)..(278): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccaccctctccgtgcgacgggccaggtaggagtgtacagtaagtacttaggctaggtaccaanacgaaacctggaccaggcctacccgaggtcctcctcactccatgatcgactacgtaccaaacgtcgggtaccctggccgtacccgagtacgtacggttccccgtaggcgtaggtcgggtcgtaagggactggtacgttacacttccgtacgaccgtcaacgccaacggccgtggggaactcccgttagaacgtttggtttactttttacgggaccctttaaggtttttaccccttagttcggttaaccggaacggtccgttaaccgggtaccccggtttacccgccccggtaacccgtcccggttaaccgttcccggtaacccgggggttttccggggggcccgggggtaaactcgggggggattaccgggaaagttcggggaaacggttaacccggaacgggtttgggaaccggggttccctaccggtaaccgtacgttcgttacccgtttcgttccgttaacccg

SEQ ID NO: 345811 - DNA, 580 bp, Homo sapiens
  misc_feature: GZ8MTXP01A1EDW.45.36.D03.1.454.CMB.2.raw
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (541)..(541): a, c, t, g, unknown or other
  misc_feature (541)..(541): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccncaggttccaggcaaggggctggagtgggtgcctnattcgaantggaagtgagaaggcctactcagactcgtgaagggccgcttcaccatctccagagacaattccaagaatgtacctctttttgctaaatcgaatagcctgagtacgttgaggacacgtctagtcttaattctgtgccgagggggacatctatgagtcgtggttcgtagttagtaatctaactactactacctactatgggggacgtcgtggggacaaacggggtccctcggtcaccgtctccgcacgccttccaccgaaggcccacgtcccggtcctttcccccgnggttcccgccctgcctcgacggacgccgaaccgtccggg

SEQ ID NO: 345812 - DNA, 597 bp, Homo sapiens
  misc_feature: GZ8MTXP01AZZ7E.45.36.D03.1.454.CMB.2.raw
  modified_base (211)..(211): a, c, t, g, unknown or other
  misc_feature (211)..(211): n is a, c, g, or t
  modified_base (306)..(306): a, c, t, g, unknown or other
  misc_feature (306)..(306): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcgagggccaggtaggagtgtcagtaagtactaggctggtaccaacagaaaccgtggccaggcctcccgaggcctcctnactccatgatgacactacccaaacgtcgggtcccctgggccgttacccagtacgtacgggtttccccgnggcgtaggtcgggtcctaggggacnggtagttcacttcncgtaaccgcaagccacgtccgtaggacgcctagagtgtattttgacttacgtttctcgttgtacgagctagtcccgttccgacctcgccgtctccgtacgttcggggcgggggtaccgaaggggtcgaggattcgggaacgacgttagttggttcggtncgcgtactnttcgtcgttcgttcc

SEQ ID NO: 345813 - DNA, 775 bp, Homo sapiens
  misc_feature: GZ8MTXP01ANGO7.45.36.D03.1.454.CMB.2.raw
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcgaggtggtggaggtcggggggagcgttgtccagccgtgggagtccctgagactctcctgtgcagcctntggactctccctnagtaactttggttccacgtcgggtcccgccgtaggttcccgaggccgaagggggtctggggagtgggggtcgccccgttgtacgtttaccggaagtacgttaggggaaacggtggaaggtaaacggtcccttaaaccgttcgaacggacccgtacccgggtaggaaacgggggtccccgtctttaccgaaccctacgtacccgtaccgaacggaacgaacctaaactttaaccccgaaaggtaaacttcggttacccttacgttttttacgaaccttaaacgttaaggggtaaacttaacggtacccgttaggtaacggttaaggttacgggtaaacgggtaaccgtaccggttaccgttacggttaccgtttagttttaaccgtggtttacggaccccggttaaggggggtacctacgttccgttacgttacggtaaggttccgttgggtttaccgttaggttacggttaaacgttaaccgtttaaaacccg

SEQ ID NO: 345814 - DNA, 692 bp, Homo sapiens
  misc_feature: GZ8MTXP01CJOW2.45.36.D03.1.454.CMB.2.raw
  modified_base (208)..(208): a, c, t, g, unknown or other
  misc_feature (208)..(208): n is a, c, g, or t
  modified_base (314)..(314): a, c, t, g, unknown or other
  misc_feature (314)..(314): n is a, c, g, or t
  modified_base (379)..(379): a, c, t, g, unknown or other
  misc_feature (379)..(379): n is a, c, g, or t
  modified_base (672)..(672): a, c, t, g, unknown or other
  misc_feature (672)..(672): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaacggaaaattgtgttgacacagtctccaggcaccctgtctctgtctcgagggganacacgccaccctctcctgcgacgggccaggtaggagtgtacagttaagtacgttaggctaggtaccaaacgacgaaaccgtggaccaggcctacccgaggcctccncactccatgatgacataccaacgcgggtccctgggccgtcccaaggtccgtacgggtttccccgngggacgtaggggtcgggtaccgtagggggaactggtagtttacccacttccgtacccgaaccggttcaacgccgacggtcccgtagggcgtccgttaggacgtttgtacttttcggacttagttttcctgttcggttacaacggtctaaccggtcccgtttcccgacccgtccgtcccgtccttacggtacccggggtttccgggggaccggggggtaactaaggggggtacgagggtacgttcgggaaacgtcggttaacgttgggttccgggaactacggcctaaccgttnttccgttaacgttccgtaac

SEQ ID NO: 345815 - DNA, 604 bp, Homo sapiens
  misc_feature: GZ8MTXP01CIEXN.45.36.D03.1.454.CMB.2.raw
  modified_base (265)..(265): a, c, t, g, unknown or other
  misc_feature (265)..(265): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (572)..(572): a, c, t, g, unknown or other
  misc_feature (572)..(572): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacaggtctccaggcaccctgtctctgtctccaggggagacagccaccctctcctgcagggccaggtaggagtgtcagtaagtacttaggctaggtaccaanagaaacctggccaggctcccaggctcctcactccatgatgcactcccaacgtcgggtcccctgggcctccccgagacgtacgggttccgtaggaacgtcgggtactggggacctaggtacgttcncgtctaccgaccgtnacgcagccgtggactccgtgacgtgtattttgcttagtttactgtcgtcgagtcgtacgggtccgttccgccaccggccgtcgtaccggtcggtttccgggggccgggggtaccgtaggggtggaaggtcgtacggacggaccgttagtcggtcgacgttcggaccnctatctagtcttcgtaacttcccgttaacccg

SEQ ID NO: 345816 - DNA, 623 bp, Homo sapiens
  misc_feature: GZ8MTXP01C65SL.45.36.D03.1.454.CMB.2.raw
  modified_base (559)..(559): a, c, t, g, unknown or other
  misc_feature (559)..(559): n is a, c, g, or t
  modified_base (568)..(568): a, c, t, g, unknown or other
  misc_feature (568)..(568): n is a, c, g, or t
  modified_base (595)..(595): a, c, t, g, unknown or other
  misc_feature (595)..(595): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
tcagacgcgatcgacacgaccggtgctcgatttagctgcgtcacgatctctcttgggggaggaattgctcagttaggacccagagggaaccatggaagccccagctcagcttctcttcctcctgctactctggctccagataccacggaaaattgtgttgacacagtctccaggcaccctgtctctgtctccgaggggagacacgccaccctctccgtgcgacgggccaggtaggagtgtcagtaagtacttaggctaggtaccaacgagaaaccgtggaccaggcctccgaggcctcctcactccatgatcgacactccaaacgacgggtcccctgggccgtacccagtaccgtacggttccggtcggcccgtagggtcgggtcgtaggggaccaaggttacgttcgacctcgtaccgacgtacgacgtcgacgtccgtggaccgtcgtgtattaggtattttgtactttacgtttacttcgtcgtacgacgcgtaacggtcccggttacccgaccgccgtcccgtcgtcgtaccgggttcgggaccgggggtaccgngggtacggngtagttggacgacgtaggtgcggttcncgcacgtntcgtnttctcgttcgtcccg

SEQ ID NO: 345817 - DNA, 561 bp, Homo sapiens
  misc_feature: GZ8MTXP01CT11N.45.36.D03.1.454.CMB.2.raw
  modified_base (263)..(263): a, c, t, g, unknown or other
  misc_feature (263)..(263): n is a, c, g, or t
  modified_base (395)..(395): a, c, t, g, unknown or other
  misc_feature (395)..(395): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaanagaaacctggccaggctcccagctcctcatccatgatgcatccaaacgcggggtcccctgggcctcccaagacctaggttccgtggcccagggtgggtctaggggacaagtacgttcactctacgacccgtnaacgcaacgccgtggacgccgtgatagtattttgactagtttacttctgtcagcgtacgtccgttccgccgacgccgtctcgtaccgttcgggccgggggaccgagggtggaagagttggagacgtaaacgtgttggcttcgcactctctgttcttcgcgttcccg

SEQ ID NO: 345818 - DNA, 524 bp, Homo sapiens
  misc_feature: GZ8MTXP01AY266.45.36.D03.1.454.CMB.2.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (507)..(507): a, c, t, g, unknown or other
  misc_feature (507)..(507): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctggtaccaacagaaacctggccaggctcccaggctccnatccatgatgcatccaangggtcccctgggcctcccagacaggttccgnggcccaggtgggtctggggacaaggacgttcactctcaccgtnagcagctgagctgatgtatttgctagtttacttctgtcagcagtcgttccgcctacgccgctcgtacgttcgggcgggggacnggggtggaagngttggagacgacgtggttggcttgcacctntctgttctcttcgtccg

SEQ ID NO: 345819 - DNA, 759 bp, Homo sapiens
  misc_feature: GZ8MTXP01E3U15.45.36.D03.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtaagtacttagggctaggtaaccaanagaaacctggccaggctcccgaggcctcctnatccatgatcgacaactccgaaacgtcggggtcccctgggcccgtaccccgaggaccgtaggggtttcccggngggccccgtaggggttggggtccgtagggggaacctaaagggtacgttcccaacttcccgtaccgacccggtcaacggtccacggtcccgtagggacggtccgtaggtaattgggttaacttttcgggtacctttaacggttttaccttcgttacggttaccgtaacggtccggtaacgggttccccggtttaccccggccccgtaacccgggtccccgtccgttacccggttaaccggggtttccggggggaccgggggggtacccgtaaggggggtcggaaacggtaggttacgggaacggttaaaccggtaaaccggtgggttacggttcgttcggtaaccaccgtaacttccggttcgttccttaaccgttaacgtttcccccg

SEQ ID NO: 345820 - DNA, 611 bp, Homo sapiens
  misc_feature: GZ8MTXP01CCD0X.45.36.D03.1.454.CMB.2.raw
  modified_base (539)..(539): a, c, t, g, unknown or other
  misc_feature (539)..(539): n is a, c, g, or t
  modified_base (583)..(583): a, c, t, g, unknown or other
  misc_feature (583)..(583): n is a, c, g, or t
  modified_base (594)..(594): a, c, t, g, unknown or other
  misc_feature (594)..(594): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaccggaaaaattgtgttgacacagtctccaggcaccctgtctctgtctccgaggggagacagccacctctcctgcgagggccaggtaggagtgtcaagtaagtacttaggctaggtaaccaacagaaaccgtggaccaaggcctacccgaggcctcctcatccatgatcgcatacccaaacgtcgggtccctgggccgtacccgaggaccgtacgggttcccggtgggccccgtagggttcggggtccgtagggggacctaagggtacgtttcgacctctccgacccggtcacggtcacgcccgtggacgcctaggattgtacttttcgacttagtttactctgtccagcgacgtccgtccgcaccgccgcgtcgtacggttcggggcgggggacnggggtcggaagagttgaagaccgtaatggttcggcttcggaacnccgtaattcgnttcttaacgcgttcccg

SEQ ID NO: 345821 - DNA, 594 bp, Homo sapiens
  misc_feature: GZ8MTXP01B254B.45.36.D03.1.454.CMB.2.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaaccggaaaaattgtgttgacacagtctccaggcacctgtctctgtctcagggganacagccacctntcctgcagggccaggtaggatgtcagtaagtcttaggctaggacaanagaaactggccaggctcccagctcctnatcatgatgcatccaaancgggtcctgggctccagcaggttccgngcgagtggtnggacagctcnctcncgacgnagcacgctggacnctgattgtactttgacttagtttactcgtgtacgtacgtacggtacgtccgttcccgtacccgaccgtcccgtccgttaccgttaccggttccggggtaccgggggtaccgggtacggggtacgggtaacggtaacggttacggtacggaacccggtaacggtacggttcggttcgttacgtcgtacgtaacgttcgttcgttacgttcgttaaccgttccg

SEQ ID NO: 345822 - DNA, 665 bp, Homo sapiens
  misc_feature: GZ8MTXP01A0NG3.45.36.D03.1.454.CMB.2.raw
  modified_base (369)..(369): a, c, t, g, unknown or other
  misc_feature (369)..(369): n is a, c, g, or t
  modified_base (434)..(434): a, c, t, g, unknown or other
  misc_feature (434)..(434): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccaggtaggagtgtcagtaagtacttaggctggtaccaacagaaacctggcccaggcctcccaggcctcctcatccatgatcgcaactcccaacgacggggtcccctgggccgttaccccgaggaccgtacggggtttcccggnggtccccgaggttcggggtcgtagggggaccaagggtacgtttcaccgttcctaccgaccccgtnaacggccgaacggtcccgtggacgccgtggattcggttattttgacgttacgtttaccttcgttcgttacgtacgtacgtacggtccggttcccgccgtaccgtcccgtcgttccgtaccgggtttccggggaccggggggtaccgtagggggtcggaaggtagttaggaacggacgtaacgtggttcggcgttacgccacgtaacgttcgtcgttctcgttaacttcccg

SEQ ID NO: 345823 - DNA, 559 bp, Homo sapiens
  misc_feature: GZ8MTXP01AYRJC.45.36.D03.1.454.CMB.2.raw
  modified_base (202)..(202): a, c, t, g, unknown or other
  misc_feature (202)..(202): n is a, c, g, or t
  modified_base (431)..(431): a, c, t, g, unknown or other
  misc_feature (431)..(431): n is a, c, g, or t
  modified_base (488)..(488): a, c, t, g, unknown or other
  misc_feature (488)..(488): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggctcccaggcctcctcatccatgatgcatcccaacgagggtcccctggccgtcccagacacggttccgtggccctaggtggggtctggggacaaggtacgttcgactctccaccgtcagtcagcctggacgctgatgtatttgctagtttactntgtcagcgtacgtcgttccgccgacgccgctcgtacggtttcggggcgggggtaccngggtcggaagtagttggaggacgtaacgtggttcgcgttgccgacctgtctgttactcgttaacttccccg

SEQ ID NO: 345824 - DNA, 779 bp, Homo sapiens
  misc_feature: GZ8MTXP01BJW14.45.36.D03.1.454.CMB.2.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgagggccaggtaggagtgtacgagtaagtacgttaggctaggtaaccaacagaaacctggaccaggcctcccgaggcctcctcactccatgatcgacactacccaaacgtcggggtcccctcgggcccgttccccgaaggtaccgtacggggtttcccgtggggtacccgtacggggttggggtaccgtacgggggaacctaaagggttaccgtttccaacccgttccctacccgtacccggttccgaacgggccgtaacggtcccgttagggaaccggtcccgttaggtaacgttggtttaacgtttttcggtactttaacggtttttaaccttcgttcggttaccgtacggtccggtaccggttcccggtttccccgacccgtacccggtccccggtcgttcccggttaccggggttttcccggggggaccggggggtaccgtaagggggtgggaacggtaggttacgggaaacgttaacggtaaacggttgggttcgggttccgttcggaacctaccgtaagttcgttcggttccttaacgttccgtttccccg

SEQ ID NO: 345825 - DNA, 590 bp, Homo sapiens
  misc_feature: GZ8MTXP01CAB1E.45.36.D03.1.454.CMB.2.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcaggccagtaggagtgtcagtaagtacttaggctggaccaacagaaacctggacccaggcctcccgaggcctcctcatccatgatgcatccaacgcgggtccctgggccgtcccagtacgtagggttcccgtggcccagggtgggtcgtggggacaaggtacgttcactctacaccgtcagcacgcctggacgctgatgtatttgactagtttacttcgtgtcagccgtagtccgttacccgccgtacgcccgtctccgtaccgggtttccggggccgggggtaccgtaggggtcggaaggtagttaggacggttacgtaacgtgggttaggcttcggccactaagtcctgttccttgttccgttcccg

SEQ ID NO: 345826 - DNA, 598 bp, Homo sapiens
  misc_feature: GZ8MTXP01BDXD1.45.36.D03.1.454.CMB.2.raw
  modified_base (201)..(201): a, c, t, g, unknown or other
  misc_feature (201)..(201): n is a, c, g, or t
  modified_base (348)..(348): a, c, t, g, unknown or other
  misc_feature (348)..(348): n is a, c, g, or t
  modified_base (393)..(393): a, c, t, g, unknown or other
  misc_feature (393)..(393): n is a, c, g, or t
  modified_base (569)..(569): a, c, t, g, unknown or other
  misc_feature (569)..(569): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctggtaccaacagaaacctggccaggcctcccgaggcctcctcatccatgatgcactccaacgcgggtcccctggccgtcccagacgtaggttccgnggccgtaggtgggtctgggacaagtacgttcactcgtacaccgtnacgcacgccgtgacgtctgattgtatttgtacttagtttacttcgtgtactacgcgtacggtccgttcccgccgtaccgtcccgtccgtccgtaccggtttccggggccgggggtaccgtgggggtcggaaggtgttggacggacgtaacgtggttacggcgttacggcctacgtnttccgtgttccttcgttaaccgtttcccg

SEQ ID NO: 345827 - DNA, 660 bp, Homo sapiens
  misc_feature: GZ8MTXP01CJ0K2.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaaccnggccaggcctcccaggcctcctnactccatgatgcactaccaacgacgggttccctgggccgtcccaggaccgtacgggtttccccgngggcgtagggttggggtccgtagggggactaaggtacgtttccaccgttcctccgacccggttcaaggccacggtccgtagggacgtccgttgattggttattttcgacttagtttacgttctgttcgacggtacctcggtcccgttcccgcccgaccgtccgtcctccgtaccggtttccgggggccggggggtacccgtaagggggttcggacggtagttcgggaacggtacgttaaccgttgggttcgaacgtcgaaccgaccgttagttccgttcgttcgtttaacccg

SEQ ID NO: 345828 - DNA, 601 bp, Homo sapiens
  misc_feature: GZ8MTXP01DYDUX.45.36.D03.1.454.CMB.2.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
  modified_base (578)..(578): a, c, t, g, unknown or other
  misc_feature (578)..(578): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtcttaggctaggtaaccaacagaaacctggccaggcctcccaggcctcctnatccatgntgcactcccaaacgacgggtccccngggcctcccagacctagggttccgtggcccgaggtggggtcgtaggggacaagtagttccacttcctacgaccgtcaggtcagccgtgggacnccgtgaattgtattttgctttagttacttcgtgttcgacgtcgtacgtccggttcccgccgaccggcccgtcctccggtaccggtttccggggccgggggtaccgtaggggtggaagagttggacgacgtaacgtggttaggcgttcggcctacgngttctcgttctcgttcttccccg

SEQ ID NO: 345829 - DNA, 678 bp, Homo sapiens
  misc_feature: GZ8MTXP01DDJUL.45.36.D03.1.454.CMB.2.raw
  modified_base (264)..(264): a, c, t, g, unknown or other
  misc_feature (264)..(264): n is a, c, g, or t
  modified_base (644)..(644): a, c, t, g, unknown or other
  misc_feature (644)..(644): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaccggaaaattgtgttgacacagtctccaggcaccctgtctctgtctccgaggggagacacgccaccctctcctgcgagggccagtaggagtgtcagtaagtacttaggctaggtaccaanagaaacctggccaggcctcccgaggcctcctcatccatgatgcactcccaaacgcggggtcccctgggacccgtccccgaggaccgtacgggtttcccggaggcccgagggttggggtccgtagggggacctaaagggtacgtttccaccgtttccgttacccgaacccggtcgaagggggacgcccggtagggtacgccgttgagttgttaagttttggactttaggttttacttcgttgtcgagtaccgtacgggtcccgtttaccgcccgtaccgccgtcctccggtacggtttccgggggaccggggggtaccgagggggtcggaggtggtggaacggaacggttaacgtgggtcggttcgttcggcctaaccgtnttccgttcgtcttacctaacgttcccgttccccg

SEQ ID NO: 345830 - DNA, 592 bp, Homo sapiens
  misc_feature: GZ8MTXP01BIITI.45.36.D03.1.454.CMB.2.raw
  modified_base (349)..(349): a, c, t, g, unknown or other
  misc_feature (349)..(349): n is a, c, g, or t
  modified_base (394)..(394): a, c, t, g, unknown or other
  misc_feature (394)..(394): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcactccatgatgcatccaacgcggggtcccctgggccgtacccagaccgtagggttccgnggccagggtgggtctggggacaaggtacgttcactctacaccgtnacgcagccgtggacgtccgtgactgtattttgacttagtttacttctagtcagcgtacgtccgttccgccaccggtcccgtcgttccgtacggtttccggggccggggggtaccgagggggtggaaggtagttggacggacgtaacgtggacggttcgttcgaaccgtactaagtcttgttccttcgttaacttcccg

SEQ ID NO: 345831 - DNA, 683 bp, Homo sapiens
  misc_feature: GZ8MTXP01AO0DN.45.36.D03.1.454.CMB.2.raw
  modified_base (401)..(401): a, c, t, g, unknown or other
  misc_feature (401)..(401): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggccaggcctcccaggcctcctcatccatgatgcatccaacgacgggtccctgggcctcccagacgtaggttccgtaggcccgtaggtggggtctaggggactaagacgttcacgtctaccgaccgtnacgcacgccgtggacgccgtagacttggtaattttcgtacgttacggttttacttcgttcgtcgaacggccggtaacggtccccggtttaccccgccccgttaaccggccccggttccgtccggttaacccgggttttccgggggtaccgggggggtacccgtaagggggttcgggaaggtaacggttgggaaacggttacccggtaaacggttgggcggttcgttccgggaacctaacccgtctttccgttcggtttacccttcgttaaccgtttcccccg

SEQ ID NO: 345832 - DNA, 736 bp, Homo sapiens
  misc_feature: GZ8MTXP01BIW30.45.36.D03.1.454.CMB.2.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (361)..(361): a, c, t, g, unknown or other
  misc_feature (361)..(361): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtntcagtaagtactaggctaggaccaanagaacctggccaggctccgagctcctcatccatgatcgcactaccaacgacgggttcccctagggccgtaccccaggtaccgtacggggtttccccggnggacccgtaggggttcggggtacgtacgggggacctaagggttaaccgttccgtaccgttcccgtacccgtaccccgtcgacggtacccgtaccggtcccggtagggaccggtccgtagtacgttacggtttacgttttcggttacgtttaacgttttaccgttcgtcgttacgtacgtccgggtaccggttcccgttaccccgacccgtacccgtcccgtaccgttacccggttaccggggtttccgggggaccggggggtaccggtagggggtacgggaacggtacggttacgggaacggttaacggtacggtcggttcgggttcgttcggtaacctaccgtcgttcgtcgttaccttcgttaaccgttcccg

SEQ ID NO: 345833 - DNA, 551 bp, Homo sapiens
  misc_feature: GZ8MTXP01AZNEA.45.36.D03.1.454.CMB.2.raw
  modified_base (202)..(202): a, c, t, g, unknown or other
  misc_feature (202)..(202): n is a, c, g, or t
  modified_base (353)..(353): a, c, t, g, unknown or other
  misc_feature (353)..(353): n is a, c, g, or t
  modified_base (405)..(405): a, c, t, g, unknown or other
  misc_feature (405)..(405): n is a, c, g, or t
  modified_base (460)..(460): a, c, t, g, unknown or other
  misc_feature (460)..(460): n is a, c, g, or t
  modified_base (504)..(504): a, c, t, g, unknown or other
  misc_feature (504)..(504): n is a, c, g, or t
  modified_base (527)..(527): a, c, t, g, unknown or other
  misc_feature (527)..(527): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatcccaaacgacggggtcccctgggccgtccccaggacctaggttcccgngggcccagggtggggtcctgggggaccaaggtacgttcacgtctcacccgtnagcagcctggacgctgatgtatttgctagtttacttctgtcagcgagtcgttccnccacgccgctcacgtttccgggcgggggtaccgagggtggaagngttggagaccgaagtgcggttcngcacaatctgttcttcgcttcccg

SEQ ID NO: 345834 - DNA, 702 bp, Homo sapiens
  misc_feature: GZ8MTXP01ENX09.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggaccaacagaacctggccaggctcccaggctcctcatccatgatgcatccaacgtacggggtcccctagggccgtacccaggtaccgtaggttcccgtggcctagggttcggggtctagggggactaaggtacgtttccacgttcctaccgaccccgttcaacggccgacggcccgttgggacgtccgtaggtaagttggttaacgtttttcggacctttacggttttacttccgttgttaccgtacggtccggtaacggttcccggtttccccgcccgtaacccgtccccggtccgttcccgtaacccgggttttcccgggggacccggggggtacccgtagggggttcggaaggtaggttacgggaaacggttaccggtaaaccggttgggttcgggttcttcgggtccacctaacgttcgttcgttcttccgttaactttccccg

SEQ ID NO: 345835 - DNA, 570 bp, Homo sapiens
  misc_feature: GZ8MTXP01BPLKK.45.36.D03.1.454.CMB.2.raw
  modified_base (390)..(390): a, c, t, g, unknown or other
  misc_feature (390)..(390): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctaggtaccaacagaaacctggccaggctcccaggctcctcatccatgatgcatccaacgcgggtccctgggccgtcccagacctaggttccgtggcccaggtgggtctggggacaagtacgttcactctcaccgtnagcagcctggacgctgatgtatttgctagtttactctgtcagcgacgtccgttccgcctacgcccgctcgtaccggtttcggggccgggggtaccagggggtcggaaggtagttgggacgacggtaacgtggttggcttcggcacctaacgttcgtcgttccttcgttaacgtttccccg

SEQ ID NO: 345836 - DNA, 588 bp, Homo sapiens
  misc_feature: GZ8MTXP01AXRDW.45.36.D03.1.454.CMB.2.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (389)..(389): a, c, t, g, unknown or other
  misc_feature (389)..(389): n is a, c, g, or t
  modified_base (453)..(453): a, c, t, g, unknown or other
  misc_feature (453)..(453): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctnagttaactttggttccactgggtccnccaggttccaggcaagggggctgggagtgggtggccctntatttccgaagatggaagtgagaaggcctactcagactcgtgaaggccgcttcacatctccagagacaattaccaagaatgtccttcttttagactaaatgaatagcctagagtagttagaggacacgtctagtctnttctgtgcgagggggacatactatgagtcgtggttcgtagtagtaatacaactactactactanagtggggacgtcggtagggacgaaagggcctcggtcacgtctccgcacgcctaaccaccgaacggcccagtcccggtcccttccccgttgggccccgtcccgtcgtcctccgacggcgtccgttaaccgtccggg

SEQ ID NO: 345837 - DNA, 643 bp, Homo sapiens
  misc_feature: GZ8MTXP01EYGA4.45.36.D03.1.454.CMB.2.raw
  modified_base (200)..(200): a, c, t, g, unknown or other
  misc_feature (200)..(200): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccagggganacagcccacctctcctgcagggccagtaggagtgtcagtaagtacttaggctaggtacaacagaaacctggccaggcctccgaggctctcatccatgatcgcactccaaacgcgggtccctgggcctccagtaccagggttcccgtgggccctagggtcgggtacgtggggaactaaggagtttcccactcctaccgacccgtcagccgacggcccgtggacgccgttaggacgtttggttaacgttttgaccttaaggttttaccttctgtactaggctcgttccggttccccaccgtccgtcccgtcgttaccggtaccgggttccgggggaccgggggtacggtaggggtcggaaggtacggttagggacgttaacggtaaggtcggttacggcttacgcctacgtcgttccgttcgttccttaaccgttcccgttcccg

SEQ ID NO: 345838 - DNA, 778 bp, Homo sapiens
  misc_feature: GZ8MTXP01EVC5G.45.36.D03.1.454.CMB.2.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcgagggccagtaggngtgtcagtaagtataggctggaccaanagaacctggccaggctcccagcctcctcatccatgatcgacactaccgaaacgtacgggggtcccctgggcccgttaccccgaggtaccgtacgggggttccccgtggggaccccgtaggggttggggtaccgtaggggggaacctaaagggttacgtttcccaacgtttcccgttaccgaaccccggttcgaacggcccgtaaacgggccccgttaggggaacggtcccgttaggtacgtttacggtttaagttttttcggtacgtttaacggtttttaacctttccgtttcggttaccgtacggtccggtaacggttcccgggtttaccccgccccgtacccggtccccgtccgttcccggttaccgggtttccgggggacccggggggggtaacccgagggggttcgggaagggtaaggttcgggaacggttaccgggtaacggttcgggttacgggcgttacggtaaccaccgtaacgttcgtacgttcctttccgttaacgtttcccccg

SEQ ID NO: 345839 - DNA, 521 bp, Homo sapiens
  misc_feature: GZ8MTXP01DFRTG.45.36.D03.1.454.CMB.2.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (331)..(331): a, c, t, g, unknown or other
  misc_feature (331)..(331): n is a, c, g, or t
  modified_base (370)..(370): a, c, t, g, unknown or other
  misc_feature (370)..(370): n is a, c, g, or t
  modified_base (456)..(456): a, c, t, g, unknown or other
  misc_feature (456)..(456): n is a, c, g, or t
  modified_base (505)..(505): a, c, t, g, unknown or other
  misc_feature (505)..(505): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccgaggggagacagccaccctctcctgcagggccagtaggagtgtcagtaagtacttaggctggacaanagaactgcaggctccagctcncatccatgatgcatccaaancgggtccctgggctcccagacaggttccgnggccaggtgggtctggggacagagttcactctcaccgtnagcagcctgagctgatgtatttgctagtttacttctgtcagcagtccgttccgccaccgccgctcgacgtttcgggcgggggaccnggggtggaagaagttggaggacgaacgtggttacgggcttggcaacctntctgttctcttctccg

SEQ ID NO: 345840 - DNA, 627 bp, Homo sapiens
  misc_feature: GZ8MTXP01BI1KK.45.36.D03.1.454.CMB.2.raw
  modified_base (203)..(203): a, c, t, g, unknown or other
  misc_feature (203)..(203): n is a, c, g, or t
  modified_base (355)..(355): a, c, t, g, unknown or other
  misc_feature (355)..(355): n is a, c, g, or t
  modified_base (411)..(411): a, c, t, g, unknown or other
  misc_feature (411)..(411): n is a, c, g, or t
  modified_base (546)..(546): a, c, t, g, unknown or other
  misc_feature (546)..(546): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctggtctccgagggganacagcccaccctctcctgcagggccagtaggagtgtcagtaagtacttaggctaggtaccaacagaaacctggccaggctcccaggctcctcatccatgatgcatcccaagacgggtcccctgggccgtccccagtaccagggtttcccggnggcccgtagggttgggtcgtaggggacctaaggacgtttcactcctaccacccgtnacggcacgcccgtggacgtcctggacttgtaattttgacttacgttttacttctgtacagcgtagtccgttcccgccgtaccgcccgtcttaccgtaccggtttcgggggccggggggtacctgggggtggaagngttagggacggttaacgaacggttggttacgggttcttacggcctacctaagtcgttcgttcctttaacgttctttccccg

SEQ ID NO: 345841 - DNA, 706 bp, Homo sapiens
  misc_feature: GZ8MTXP01BNKPF.45.36.D03.1.454.CMB.2.raw
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
  modified_base (380)..(380): a, c, t, g, unknown or other
  misc_feature (380)..(380): n is a, c, g, or t
tcagacgcgatcgacacgaccggtgctcgatttagctgcgtcacgatctctcttgggggggagacgagcccagcactggaagtcgccggtgtttcctttcggtgatcatcactgaacacagaggactcaccatggactttgggctgaccttgggttttcctcgttgcttcttttaagaggtgtccagtgtcaggtgcagggtggtggaggtcggggggagtcgttgtccagccgtgggacgtcctgagctctcctgtgcagcctntggattcnccctnagtaactttggttccacgtgggtccnctaggttccaggcaagggggctgggagtggggtcgcccctgatttccgaagtntaggaagtgagaacggcctactnacgctccgtgaacgggccacttcaccatctaccagacgactaactccaaagtacttgttccttacgtttttagactaaaataggtaaataacgtacctaggggaagtaaggtttacggaacgggtaccgtaacggttccgttagttacgtttaacgtttccgtaggttcggtacccgggtaaaggggggtaacccttaaggttaccgttaaagtcgggttaaggtttccgggtttgggtttacccgggtttaagggttaacggtttaacgttaaccgttaaaacccgtttaaccgtttaaaccccgtttaacccgtttaaacccgg

SEQ ID NO: 345842 - DNA, 601 bp, Homo sapiens
  misc_feature: GZ8MTXP01CKIXN.45.36.D03.1.454.CMB.2.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (263)..(263): a, c, t, g, unknown or other
  misc_feature (263)..(263): n is a, c, g, or t
  modified_base (349)..(349): a, c, t, g, unknown or other
  misc_feature (349)..(349): n is a, c, g, or t
  modified_base (405)..(405): a, c, t, g, unknown or other
  misc_feature (405)..(405): n is a, c, g, or t
  modified_base (527)..(527): a, c, t, g, unknown or other
  misc_feature (527)..(527): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgccaccctntcctgcagggccagtaggagtgtcagtaagtcttaggctggtaccaanagaaacctggccaggctccagctcctcatcatgatgcatccaacgacgggtcccctgggccgtacccagttaaccgcggttcccgnggccctagggtgggtcgtaggggacctaaggtaacgtttcacgttccgtcaccgtnacggcacgtccgtggacgtccgtgaattgtactttttcggacttaacgtttctctggtacacgcgtacgtccgttcccgccgaccgtcccgtcgtcgtaccggttcgggggccgggggtacngggggtgaagtgacggacgacgtacgtggttcggcttacggcctactgttccgtcgttccttcaacgttccccg

SEQ ID NO: 345843 - DNA, 757 bp, Homo sapiens
  misc_feature: GZ8MTXP01DGIEP.45.36.D03.1.454.CMB.2.raw
  modified_base (206)..(206): a, c, t, g, unknown or other
  misc_feature (206)..(206): n is a, c, g, or t
  modified_base (537)..(537): a, c, t, g, unknown or other
  misc_feature (537)..(537): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccacggaaaattgtgttgacacagtctcaggcacctgtctctgtctccgagggganacagccacctctcctgacacgggccaggtaggagtgtactagtaagtacgttaggctacggtaaccaaacgaagtaaaacccgtcggaccacgggcctaccccgaagggtcccttaccctcaacttacccgaagttacggaacttcggacctaaacgttaccccgaaaacggtccgggggtttaccccctcgggggtaccccgtaccccgtaaggtaacccgtacggggttttcccccccggagggtacgtagggtcggggtacgtacggggaacctaaggtacgtttcaccgttactaccgaccgtcacgggacacggtccgtagggacnccgttagaagttaggttttacttacggtactttacgttttcttacgtacgtacggtacgtacgtaccggttcccgtaccgcccgtaccggtccgtaccgttaccgggtaccggggttaccggggggaccggggtaacgtaaggggtacgacggtacggttaggaacggtaacggttcggttggacggtctacgaaccgtactgttccgttaacgttcgtc

SEQ ID NO: 345844 - DNA, 555 bp, Homo sapiens
  misc_feature: GZ8MTXP01DGS11.45.36.D03.1.454.CMB.2.raw
  modified_base (200)..(200): a, c, t, g, unknown or other
  misc_feature (200)..(200): n is a, c, g, or t
  modified_base (283)..(283): a, c, t, g, unknown or other
  misc_feature (283)..(283): n is a, c, g, or t
  modified_base (510)..(510): a, c, t, g, unknown or other
  misc_feature (510)..(510): n is a, c, g, or t
  modified_base (536)..(536): a, c, t, g, unknown or other
  misc_feature (536)..(536): n is a, c, g, or t
  modified_base (541)..(542): a, c, t, g, unknown or other
  misc_feature (541)..(542): n is a, c, g, or t
  modified_base (544)..(552): a, c, t, g, unknown or other
  misc_feature (544)..(552): n is a, c, g, or t
  modified_base (554)..(555): a, c, t, g, unknown or other
  misc_feature (554)..(555): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccaggcaccctgtctctgtctccagggganacagccacctctcctgcagggccagtaggagtgtcaactaggttccgtggcagtgggtctgggacagagtcactctcaccgtnagcagcctggagcctgactgtatttgactagttttactctgtcacgcgtaacgtcccgttacccgctaccggtcccgcttaaccgtacggtttccgggggcggggggtaacccagggggttcggacgtagtacggacggacgtaacgtggtcgggctacgctaccctattctacgttcttacacttccttcccgctacgttcctagacttcggactcgtacgttcgnggtcggcgcgtggaacgaggcgtacngtagnngnnnnnnnnngnn

SEQ ID NO: 345845 - DNA, 648 bp, Homo sapiens
  misc_feature: GZ8MTXP01B5WLQ.45.36.D03.1.454.CMB.2.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaaccggaaaattgtgttgacacagtctccaggcaccctgtctctgtctccgagggganacagccaccctctcctgcgagggccaggtaggagtgtacagttaagtacgttaggctaggtaaccaacaacgaaaccgtggacccaggcctcccgaggcctcctcactccatgatgactactacccgaacgtacggggtcccctgggcccgtacccgaggtaccgtacggggtttcccggngggacccgtaggggttcggggtcgtagggggaacctaagggtacgtttccgacttccgtacccgacccgtcacggcacgtccgtggacgcgtgtagttgtatttgacttagtttacttcgtgtcgagcgtacgtccgttccgccgaccgcccgtccgtacgtaccggttcggggccgggggtacgaggggtggaagtagttggaacggacgtaacgtgggttcggcgttcgaaccacgtcgttcgtgttccttcgttcgttccccg

SEQ ID NO: 345846 - DNA, 708 bp, Homo sapiens
  misc_feature: GZ8MTXP01CCNX6.45.36.D03.1.454.CMB.2.raw
  modified_base (350)..(350): a, c, t, g, unknown or other
  misc_feature (350)..(350): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctaggtaccaacagaaacctggaccaggcctcccgaggcctcctcatccatgatgcatccaacacgggtcccctgggcctcccagacgacggttccgnggccaggtgggtctgggacaagtacgttcactcctaccgaccgtcacgtcgacgtcccgtagggactcccgtagtagttggttaactttttcggactttaacggttttaccttcgttgggtacctacggtaccggtacggttccccggtttccccgaccccgtaaccggtccccgtcccgttacccggttaaacccggggtttcccggggggacccggggggggtaacccgtaggggggttcgggaacggtaggttacgggaaacgggaaccggtaaaccggttgggttcgggttccgttacggaaccctaaaccgtcgtttccgttacgggtttccttccttaaccgttttcccccg

SEQ ID NO: 345847 - DNA, 582 bp, Homo sapiens
  misc_feature: GZ8MTXP01DPR45.45.36.D03.1.454.CMB.2.raw
  modified_base (265)..(265): a, c, t, g, unknown or other
  misc_feature (265)..(265): n is a, c, g, or t
  modified_base (348)..(348): a, c, t, g, unknown or other
  misc_feature (348)..(348): n is a, c, g, or t
  modified_base (440)..(440): a, c, t, g, unknown or other
  misc_feature (440)..(440): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctaggtaccaanacgaaactggccaggctcccagctcctcatcatgatgcactcaaacgcgggtcccctgggccgtcccagacctagggttccgnggccagggtgggtcgtggggacaggtacgttcacgtcctcgaccgtcagcacgcgtgacgctgatgtatttgtcttagtttacttctgtacngtcgtacgtccgttccgccgaccggcccgtcgtcgtaccggtttcggggccgggggtaccgtggggtgggaagtgttaggacggacgtaacgtcggttacggcgttcgccgaactcgttcgtcgttcttcgttcgttccccg

SEQ ID NO: 345848 - DNA, 774 bp, Homo sapiens
  misc_feature: GZ8MTXP01EO46J.45.36.D03.1.454.CMB.2.raw
  modified_base (211)..(211): a, c, t, g, unknown or other
  misc_feature (211)..(211): n is a, c, g, or t
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaccaacagaaaccnggaccaggcctcccgaggcctcctcatccatgatcgacactacccaacgaccgggttccctgggccctacccgaaggaccgtaggggtttccccccgngggactagggtcggggtcgtagggggacctgggtagtttaccctaaaccgttttccgaaccccggttcacgggtacccgtaacggtcccgttagggaacggtccccgttaggaacgttttacggttaagttttttcggacccgtttaaacgggtttttacccttccgtttagggttacctaaacgggggtccgtaacggggttaccccggtttccccgccccgaacccggtccccggtccgtttaccccggtaaccgggtttttcccggggggggaccggggggtaacccggtagggggtaacgggaacggttaggttacggggaaacggtaaacgggtaaccgttggggttcggcgtcggcctaacgtacgtcttcgttccgtttcttaacccg

SEQ ID NO: 345849 - DNA, 688 bp, Homo sapiens
  misc_feature: GZ8MTXP01BZ3HT.45.36.D03.1.454.CMB.2.raw
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccacctctcctgcgagggccaggtaggagtgtcagtaagtacttaggctaggtaaccaanacgaaacctggaccaaggcctcccgaggcctcctacatccatgatcgcatcccaaacgcgggtacccctgggccgtacccgagaccgtacggttccgtggccgtagggtggtccgtaggggaccaaggtacgtttcacctccgtccgacccggtcagggaccacggtccgtgggacgtccgtaggtattggtaatttttcggacctttaggtttaccttcgtacgttcgaacgtccggtaagtcccgggtttaccccgacccgtaccgtcccgtccgttaccggttacccgggtttccggggggacccgggggtacgtaggggcgggtaaggtacggttacggaacggaccggtacgtgggttcggttccgttacgaacccgtacttcgttcgtacgttccttaaccgttccgttcccg

SEQ ID NO: 345850 - DNA, 621 bp, Homo sapiens
  misc_feature: GZ8MTXP01B216V.45.36.D03.1.454.CMB.2.raw
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (540)..(540): a, c, t, g, unknown or other
  misc_feature (540)..(540): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggagacagccaccctctcctgcagggccagtaggagtgtcagtaagtacttaggctaggtaccaacagaaacctggaccaggctcccgagcctcctnatccatgatgcatccaaacgcgggtccccngggcctcccgagacctaggggttccgtggccccagggtcggggtctagggggacctaagggacgtttccaacttcctaccgaccggtcaacggcacgccgtgggacgtccgtgagttaggtattttcggacttacgttttacttcttcgtcgacgcgtacgtccggttacccgccgtaccgcccgtccgtcgtaccggttcggggcgggggtaccgnggggtgggaagaacgttggacggacgtaacggtggttacggcgttcgcgaccgtcttcgtcttcttcgttaacgttccccg

SEQ ID NO: 345851 - DNA, 618 bp, Homo sapiens
  misc_feature: GZ8MTXP01BGQHJ.45.36.D03.1.454.CMB.2.raw
  modified_base (211)..(211): a, c, t, g, unknown or other
  misc_feature (211)..(211): n is a, c, g, or t
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
  modified_base (602)..(602): a, c, t, g, unknown or other
  misc_feature (602)..(602): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaaccnggccaggctccaggctcctnatccatgatgcactccaacgtacgggtccctaggccgtcccagaccgtacgggttccccgtggcgtagggtcggggtcctagggggaccaagggtacgtttccaaccgttctaccgaccgttcgaacgcgagcccgtgggactccgtgacgttgttagttttcgacttagtttacttcgtacggttacaggtcctacggtcccgttccgcccgtaccgccgtctcgtaccggtttcggggccgggggtacaagggggtgaggtagttcgggaagtaacgagttggttacggctcggcacgtnttcttgttccttaacg

SEQ ID NO: 345852 - DNA, 657 bp, Homo sapiens
  misc_feature: GZ8MTXP01ECPL4.45.36.D03.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (341)..(341): a, c, t, g, unknown or other
  misc_feature (341)..(341): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtactaggctaggacaanagaaactggcaggctcccagctcctcatccatgatgcatccaaacgcgggtcccctgggcctacccagactacggttccgnggcccagggtgggtctggggacctaaggtacgttcactctaccaccgtcaggcacgccgtggacgccgtgtattagttattttcgtacgttaggttttacttcgtgtttacgagacggtacggtcccggtttacccgccccgtaccggtccccgtccgttcccggtaccggttttccgggggccggggggtaacccgtacggggggttgggaacgggtggttaggaacgggttaaccggtaaacggttcgggttcgggccgttacgccggtaaccgtcttccgttcggttacctttcccgttaacgttttcccccg

SEQ ID NO: 345853 - DNA, 642 bp, Homo sapiens
  misc_feature: GZ8MTXP01DUAGQ.45.36.D03.1.454.CMB.2.raw
  modified_base (569)..(569): a, c, t, g, unknown or other
  misc_feature (569)..(569): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaattgtgttgacacagtctccaggcaccctgtctctgtctccgaggggagacacgccaccctctcctgcgagggccaggtaggagtgtacgaagtaagttacttagggctagggtaaccaaagacgaaaccgtggaccaggcctacccgaggcctccgcactccatgatcgacactaccgaaacgacgggtccctgggccgtaccgagtacgtacgggttcgcggtccgtagggtcgggtcgtaggggacctaaggtacgttccacgtccgtaccgtaaccgtcgaacgcgacgtccgtggacgtccgtgtagttgttatttcggactttacgtttactcgtagttacagcgtacgtccgtacccgcgacgtccgtcgtcgtacgggttcggggccgggggtactgggggtgcggtagnggaaacgacggtaacgtgggcggttcttacggcccacgttaacgtcgtcgttacctccttaacggtttccccg

SEQ ID NO: 345854 - DNA, 736 bp, Homo sapiens
  misc_feature: GZ8MTXP01BWVJM.45.36.D03.1.454.CMB.2.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcgagggccagtaggagtgtcagtaagtctaggctggacaanagaactggcaggctccagctccnatccatgatgcactacccaacgacggggtcccctgggcccgtcccaggtaccgtacgggttcccggtaggggccccgtaggggttcgggggtaccgttaggggggaaccctaaaagggtacggttttcccaaaccgttcccgttacccgaacccccggttacgaacggtccgaaaccgggtaccccgttggggaaccggtccccgttggtaacgttaggttaaacgtttttttgggacctttacgggttttaccttcgttacgttactacggtcggtaccggtcggtttccccgacccgtaccgcccgtccttccggtaccgggtttccgggggccggggggtaccgtagggggtcgggaaggtaagttcgggaacgttacggtaacgttgggttagggccgttagggcctacccgtaagttccgttcggttccttccttaacgttcccccg

SEQ ID NO: 345855 - DNA, 573 bp, Homo sapiens
  misc_feature: GZ8MTXP01AIYA6.45.36.D03.1.454.CMB.2.raw
  modified_base (505)..(505): a, c, t, g, unknown or other
  misc_feature (505)..(505): n is a, c, g, or t
  modified_base (548)..(548): a, c, t, g, unknown or other
  misc_feature (548)..(548): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccacccgtctccctgcagggccagtaggagtgtcagtaagtacttaggctggtaccaacagaaactgccaggctcccagctcctcatccatgatgcactccaacgtacgggtcccctgggcccgtacccagacctaggttcccgtggcccaggtggggtctgggggaccaagggtagttcacgtccgtcacccgtcagccagccgtggacgtccgtggtatgtatttgcttagtttacttcgtgtcagcgagtccgtccgccacgccgtctccgtacggttcgggccgggggtaccgnggggtggaagagttggacgacgtaacgtggttcggcgttcgcncctaagtctgttccttcgcttcccg

SEQ ID NO: 345856 - DNA, 686 bp, Homo sapiens
  misc_feature: GZ8MTXP01A5HFW.45.36.D03.1.454.CMB.2.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggganacagcccaccctctcctgcagggccagtaggagtgtcagtaagtacttaggctaggtaccaacagaaacctggccaggcctcccgaggcctccncatccatgatgcatccaacgcgggtccccngggtccgtcccgagtaccgtaggtcccgtgggcctagggtcggggtcgtaggggactaagtacgttccgactccgtccaacccgtcgacgtccgacgtcccgttagggacgtccgtggtacttaggttacgttttcgaccgtttaagttttaccttcgtaggttaccgaacggtcggtaacggttccccggtttcccgacccgtacccggtcccgaccgttcccggtaccgggtttccggggggaccggggggtaccgtagggggtggaacggtagttacgggaacgggttacgtaaaccggttgggttacggcgttacggaacctaccgtcgttcgtacggttcttcgaacctttccccg

SEQ ID NO: 345857 - DNA, 725 bp, Homo sapiens
  misc_feature: GZ8MTXP01BYCZK.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaccaacagaaacctggccaggcctcccgaggcctcctcatccatgatcgacactacccaaacgcgggtcccctgggccgtaccccgaggtaccgtacggggttcccggtgggtcccgtaggttcggggtcgtggggacaagggtacgttccacctccgtaccgacccgttcgaacggccgacggtcccgtgggacgtccgtgtagttgttaagttttcgacttacgttttaacgttcgtacgttacgtacggtccggtacggttcccggttccccgcccggtacccggtccccgtcccgttccgtaaccggggttttcccgggggccgggggggtaacccgtagggggttcgggaaccggtagggttacgggaacgggttaaccgggtaaacggttcgggttcgggttcgttccgggaacctaccggtaacttcgttacggttccttccttaaccggttttcccccg

SEQ ID NO: 345858 - DNA, 716 bp, Homo sapiens
  misc_feature: GZ8MTXP01EH57W.45.36.D03.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcgagggccaggtaggagtgtcagtaagtactaggctaggtaccaacagaaacctggccaggctccagctcncatcatgatcgacactaccaaacgaccgggtcccgtcgggccgtaccccgagtaccgtacggggttccggtacggaccgtacgggttggggtccgtagggggaacctaaagggtacgttccgaacttcctaccgaccggtaccaaggcgaacgcccgtgggaacgtccgtagtacgttgttaattttcgggactttacggttttaacctccgttaggtacctaacggtccggtaacggttccccggtttccccgacccgtaacccggcccgtaccgttaccggtaacccgggtttccggggggacccgggggttaacccgagggggttcggaagtaaggttcggaacgttaccgggtaacgtggttacgggcttacggaacctaacctcgtttccgtcgtttccttaaccgttcgtttcccccg

SEQ ID NO: 345859 - DNA, 683 bp, Homo sapiens
  misc_feature: GZ8MTXP01DY1FD.45.36.D03.1.454.CMB.2.raw
  modified_base (209)..(209): a, c, t, g, unknown or other
  misc_feature (209)..(209): n is a, c, g, or t
  modified_base (308)..(308): a, c, t, g, unknown or other
  misc_feature (308)..(308): n is a, c, g, or t
  modified_base (670)..(670): a, c, t, g, unknown or other
  misc_feature (670)..(670): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaccggaaaattgtgttgacacagtctccaggcaccctgtctctgtctccgagggganacacgcccaccctctcctgcgacgggccagtaggagtgtcagtaagtacttaggctaggtaaccaacagaaacctggaccaggcctaccaggcctcctnactccatgatcgacataccaaacgtcgggtccctggcccgtacccaggaccgtacgggtttcccgaggtcgtagggttcggggtactacggggaactgggtacttccgaccttccgtaccgaacccggttgaaacgccgtaacggtcccgtaggggactcccgttaggtaacttgggttaacttttggacctttaagtttaccttgttcgtacgtacgtccgtacggtcccgttcccgccctccggtcccggtaccttaccggttaccgggtttccggggggaccgggggtaaccgtaaggggtacgggacggagttacggaacggtaaccgttaagttggttacggctggaacctaccgtnttcgtcgttcgtc

SEQ ID NO: 345860 - DNA, 567 bp, Homo sapiens
  misc_feature: GZ8MTXP01DPEZ8.45.36.D03.1.454.CMB.2.raw
  modified_base (199)..(199): a, c, t, g, unknown or other
  misc_feature (199)..(199): n is a, c, g, or t
  modified_base (339)..(339): a, c, t, g, unknown or other
  misc_feature (339)..(339): n is a, c, g, or t
  modified_base (394)..(394): a, c, t, g, unknown or other
  misc_feature (394)..(394): n is a, c, g, or t
  modified_base (485)..(485): a, c, t, g, unknown or other
  misc_feature (485)..(485): n is a, c, g, or t
  modified_base (542)..(542): a, c, t, g, unknown or other
  misc_feature (542)..(542): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccacggaaaattgtgttgacacagtctccaggcaccctgtctctgtctccgagggganacagccaccctctcctgcagggccagtaggagtgtcagtaagtacttaggctggtacaacgagaacctggccaggctccaggctcctcatcatgatgacatccaacgtcgggtccctggccgtccagacctaggttccgnggccaggtgggtctggggacaagtagttcactctaccacgtcagcacgcgtgacnctgattgtattttcgacttagtttactcgtgtctagcgtacgtccgttccgccgacgtcccgctacgtaccggttcggggcgggggaccgnggggtcggaagtagttcgggaaacgcgtaacgtggttcgttcgttcgaacctaacgnttcgtgttccttcgaacctttcccg

SEQ ID NO: 345861 - DNA, 793 bp, Homo sapiens
  misc_feature: GZ8MTXP01CAXUR.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcgagggccagtaggagtgtcagtaagtacttaggctaggtaccaacgagaaacctggccaggcctcccgaggcctcctcactcccatgatcgacactacccgaaacgccgggggttcccctacggggcccgtacccccgaggtaccgtacggggtttccccggtaggggcccgtaggggttcgggggtcgtacgggggaaccgaagggttaacgttccgaaaccgtttccctacccgtacccggtcaacgggccaacgggtcccgttaggggaccgtcccgtaggtagttacggttaacgtttttcggtaccgttttacggtttttaccttccgtttacggttccgtaaccggtccgggtaacgggtttcccccggtttaccccggaccccgtaacccgggtccccgtcccgtttacccgggtaccgggggttttcccgggggacccggggggtaccggtacgggggtgggaacgggtggttacgggaacggttaaccgggtaacgttcgggttacggaccgttcggtaaccctacgtcgtttcgtcgtttaccgttccgttaacgtttccccg

SEQ ID NO: 345862 - DNA, 551 bp, Homo sapiens
  misc_feature: GZ8MTXP01A2S4F.45.36.D03.1.454.CMB.2.raw
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (543)..(543): a, c, t, g, unknown or other
  misc_feature (543)..(543): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggganacagccaccctctcctgcagggccagtaggagtgtcagtaagtacttaggctggtaccaacagaaacctggccaggctcccaggctcctcatccatgatgcatccaagcgggtcccctggcctcccagaccaggttccgnggccaggtgggtctgggacagagttcactcncaccgtcagcacgcctggacgcctgatgtatttgctagtttacttctgtcagcacgtcgttccgccaccgccgctccgtacggtttccggggcgggggtaccgagggggtggaaggtagttggaaggacggaacgtggttacgggcttcggcaccgaagttcctgttcttcncgttcccg

SEQ ID NO: 345863 - DNA, 724 bp, Homo sapiens
  misc_feature: GZ8MTXP01CT9WS.45.36.D03.1.454.CMB.2.raw
  modified_base (210)..(210): a, c, t, g, unknown or other
  misc_feature (210)..(210): n is a, c, g, or t
  modified_base (343)..(343): a, c, t, g, unknown or other
  misc_feature (343)..(343): n is a, c, g, or t
  modified_base (644)..(644): a, c, t, g, unknown or other
  misc_feature (644)..(644): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtacagtaagtacttaggctggtaaccaacgagaaacctggaccaggcctcccgaggcctcctcatccatgatcgacactacccgaacgacgggttcccngggccctcccgaaggtaccgtacggggtttcccccgtggggctaggggttcggggtaccgttacgggggaacctaagggtacgttttacccgaaccgtttcccgaccgtaaccccggttcgaacggaccgacggtccccggttaggggacgtcccgttaggtaacgtttgggtttactttttgggacctttagttttaaccttcgttcggttacgtacgtccggtaccgtcccggtttcccgacccgaccggtcccggtcctccggtaaccggggtttccgggggccggggggttaaccgngggggttacggaggtacgaggaacggacggttaacgttgggacggtcgtcggaacgctacgttcgttcgttcgtttaacc

SEQ ID NO: 345864 - DNA, 722 bp, Homo sapiens
  misc_feature: GZ8MTXP01B8TSQ.45.36.D03.1.454.CMB.2.raw
  modified_base (408)..(408): a, c, t, g, unknown or other
  misc_feature (408)..(408): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccaggtaggagtgtcagtaagtacttaggctaggtaccaacagaaaccgtggccaggcctcccaggcctcctcatccatgatcgcaatcccaaacgtacgggtcccctgggcctacccgagtcgtacgggttcccgtggccaggttgggctggggacaaggtacgttcactctaccgacccgtnacggcgacgtcccgtaggacgtcctaggtagttggttaagtttttcggacgtttaacggttttaaccttcccgttgttaccggaacgtaccggtacggttccccggtttaccccgccccgttaacccggccccgtcccggttaccgttaccccggggttttccgggggacccgggggggtacccgtacgggggttacgggaagtaacgggttcggaacgggaaaccgggttaaaccgttgggttcgggcggttaccgggaacccacccggtaacttccgttacgggtttcccttaaccggttcgtttccccccg

SEQ ID NO: 345865 - DNA, 849 bp, Homo sapiens
  misc_feature: GZ8MTXP01BUILO.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccacctctcctgcagggccaggtaggagtgtcaagtaagtacttaggctaggtaccaacagaaacctggaccaggctcccgaggctcctcatccatgatcgacactacccaaacgtacgggggtcccctgggcccgttaccccaaggtacccgtacggggtttccccggtagggaccccgtaggggttcgggggtacccgttggggggaacctaaacgggtaacggttttcccaaaccgtttcccgttacccgaaccccggttcgaaacggccgtaacggtccccgttaggggaacgtccccgttagggtaactttaggtttaacgttttttcggtaccgtttaacgggtttttaacctttcgttcgggttaccttaaacgggtcccgtaacggggttccccggtttcccccggaccccgtaacccggtccccggtaccgttcccggttaaaccccggggttttcccggggggacccggggggggttaaccccgtaaggggggttcggggaaacgggtaacggttaggggtaaacgggaaccgggtaaaccggttggggttcggggttaccttccgggaaccctaaccggttaacctttccggttccggtttacccgtttcccgttaaccggttttcccccg

SEQ ID NO: 345866 - DNA, 722 bp, Homo sapiens
  misc_feature: GZ8MTXP01AIWPJ.45.36.D03.1.454.CMB.2.raw
  modified_base (338)..(338): a, c, t, g, unknown or other
  misc_feature (338)..(338): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcagggccaggtaggagtgtcaagtaagtacttaggctaggtaccaacagaaacctggccaggcctcccgaggcctccgtcactccatgatcgacactaccgaacgcgggttccccgngggtcccgtaccccgaggaccgtacgggttcccggtcgggaccctaggggttcggggtccgtacgggggactaaacgggtacgttcctaccgtccttaccgacccggttcgacggcgaacggtcccgtagggacgtccgtaggtaacgtggttacgttttcgctttaacggttttactcgttcgtcgtaacgccgggttacggtcccggttcccgcccgtacccggtcccgtccgttacccggttaccggggttcccgggggaaccggggggtacccgtagggggttcgggaacggttaacggagggtacggaacggtaccgttggggcgttccgttcgggaacccacgtcgttcgttcggttcctttcttaaccgtttccccg

SEQ ID NO: 345867 - DNA, 683 bp, Homo sapiens
  misc_feature: GZ8MTXP01EHXYX.45.36.D03.1.454.CMB.2.raw
  modified_base (210)..(210): a, c, t, g, unknown or other
  misc_feature (210)..(210): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccaggggganacagccaccctctcctgcagggccaagtaggagtgtcagtaagtacttaggctaggtaaccaacgaagaaacctggacccaaggcctacccaggcctcctacatccatgatcganactaccaacgcgggtaccctggccgtcccagactacggttcccccggnggagtaggtcggtcgtaacgggactaagtacgtaccacctccgtacgtaccgtcgacgccgacgtaccggtggacgtacgttaggtatttacgtttacgttttccgacgtttacgttttactcgttacggaccgtagtaccgtaccgtcccgttacccgcccgtaaccgtcccgtaccgttacggtaccggggttccgggggaccgggggaacgtaaggggtaaggagtaacggttacggaaaccggtaacgttaacggttgggttacgaacgtcgaacctccgtagttacctttcgttaacgttaaccg

SEQ ID NO: 345868 - DNA, 731 bp, Homo sapiens
  misc_feature: GZ8MTXP01E0T9S.45.36.D03.1.454.CMB.2.raw
  modified_base (205)..(205): a, c, t, g, unknown or other
  misc_feature (205)..(205): n is a, c, g, or t
  modified_base (333)..(333): a, c, t, g, unknown or other
  misc_feature (333)..(333): n is a, c, g, or t
  modified_base (363)..(363): a, c, t, g, unknown or other
  misc_feature (363)..(363): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacacgccaccctctcctgcagggccagtaggagtgtcagtaagtacttaggctggtaaccaacagaaacctggccaggcctcccaggctccctcactccatgatgacactccaaacgcggggtccccngggcccgtcccagaccgtacgggttcccgngggcccgtagggtcggggtcgtgggggactaacgggtacgttccacctctacccgacccgttacacggtccgacggtcccgtgggacgtcccgtgtagttggttaacgttttcgtaccgtttaacggttttaccttcgttcggttacgtacggtccggtacggttccccgggtttccccgccccgtaacccgtccccgtccgttaccggtaacccgggttttccgggggcccggggggtacccggtacgggggtgggtaaacggtaggttagggaacgggttaaccggtaacggtcgggttcgggccgttacggaaccctaccgtaacgttccgttcggttaccgtttccgttaacccgttttccccg

SEQ ID NO: 345869 - DNA, 548 bp, Homo sapiens
  misc_feature: GZ8MTXP01ASBEG.45.36.D03.1.454.CMB.2.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (473)..(473): a, c, t, g, unknown or other
  misc_feature (473)..(473): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctccncatccatgatgcatccaangggtcccctgggccgtcccagacaggttcccgnggccaggtgggtctggggacagacgttcactctcgaccgtnacgcagcctggacgcctgatgtatttgctagtttactctgtcagcgagtcgttccgccacgccgctcgtaccggttcgggcgggggaccnggggtcggaaggagttggaggacgtaacgtggttcgggcttcggcaccgtaatccgtggttctcgttcgttcccg

SEQ ID NO: 345870 - DNA, 715 bp, Homo sapiens
  misc_feature: GZ8MTXP01BCXV1.45.36.D03.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (451)..(451): a, c, t, g, unknown or other
  misc_feature (451)..(451): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggcctcccgaggctccncactccatgatgacactccaaacgcggggtcccctcgggccgttaccccgaggtaccgtacggggttcccggtaggaccccgtagggttgggggtaccgtagggggacctaaagggtacggttcacgttcctccgaccgtcacgcacgccgtggacncctagacgttgtacttttcgacttagtttctacgtgtactacggctacggtccggttcccgaccgtaccggtcccgccgttccggttaacccgggtttccggggggaccgggggggtaacccgtagggggtacggggtaacggtaggttaggggaaacggttaccgggtaaacggttgggttaccggggttcgttaccgggtaaccctaaacccggttctttcccgggttcgtttcccgttaacccgttaaccgttttcccccg

SEQ ID NO: 345871 - DNA, 849 bp, Homo sapiens
  misc_feature: GZ8MTXP01AOHDK.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaanagaaacctggccaggctcccaggcctcctcatccatgatcgcactccaaacgcggggtcccctgggcccgtccccgaggtaccgtacggggtttcccgtcgggacccgtagggtcgggggtacgttacggggggaacctaaagggtaacgttttcccaaccttcccgtacccgtaaccccggttcgaacgggtccgtaacgggcccgttacgggaaccggtcccgttaggtacgttacggttaagtttttcgggtacctttaacgggtttttaacccgtttccgttcgggttaccgtaacgggtacccgtacggggttaccccggttttacccccggccccggtaaccccggtccccggtcccgtttaccccgggttaacccggggtttttcccgggggggaccccgggggggggttaacccggtaaccgggggggttacggggtaaacgggaacgggttaggggaaacggggttaaaccggtaaacccgggtttaggggcggggttcccgttccgggtaacccggaaacccgtaacgttcccgttacggtttcccgtttaaccgttaacccgttttccccccggg

SEQ ID NO: 345872 - DNA, 631 bp, Homo sapiens
  misc_feature: GZ8MTXP01C08EG.45.36.D03.1.454.CMB.2.raw
  modified_base (204)..(204): a, c, t, g, unknown or other
  misc_feature (204)..(204): n is a, c, g, or t
  modified_base (440)..(440): a, c, t, g, unknown or other
  misc_feature (440)..(440): n is a, c, g, or t
  modified_base (505)..(505): a, c, t, g, unknown or other
  misc_feature (505)..(505): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccacctctcctgcgagggccagtaggagtgtacaagtaagtacttaggctaggtaaccaaacaagaaaccgtggacccaaggccctacccgaggtcctcctcatccatgatcgcaactaccaacgtacggtcccctggccgtacccaagacgtacggttccggtggcccgtagggtgggtccgaggggaaccaagggtacttcactcgtaccgaacggtcagcagtcccgnggacgtcgtagtattcgttattttggacttagtttactcgtgtcgaagcgtacgtccggttcccnccgaccgtccgtcgtccggtacgggttccgggggaccggggtacgtaggggtggaagtagaggaacgacggtaacgtggttcggcgttcgaactacctgttcgttcgttcttaacgttccgttccc

SEQ ID NO: 345873 - DNA, 736 bp, Homo sapiens
  misc_feature: GZ8MTXP01D2HCG.45.36.D03.1.454.CMB.2.raw
  modified_base (209)..(209): a, c, t, g, unknown or other
  misc_feature (209)..(209): n is a, c, g, or t
  modified_base (387)..(387): a, c, t, g, unknown or other
  misc_feature (387)..(387): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaccggaaaattgtgttgacacagtctccaggcacccagtctctgtctccgagggganacagcccaccctctcctgcgaggccaggtaggagtgtacagtaagtacttaggctaggtacaacaagaaaccgtggaccaggcctacccgaggccctccgtcactaccatgaatcgacctaactaccgaacgtaccgggttccctcgggcctacccgagaccgtacgggtttccccgnggacgtagggtcgggtccgtaagggggaacctaaggtacgtttaccaaccgttccgtacccgtaccggtcgaaacgcccgtacggtacccggtgggacgtacccgttaggtaacgtttcggttagtttttcggacctttacggttttactcgttacgtcggtaacggtccgtaacgggttccccgttaccccggacccgtcccggtcccgtaccgttcccggttaccgggggtttacccgggggcgggggtaaccggtaagggggtcggaggtacgttagggaacgtaccggttaagttcggttacggtcgtagaacccgtacgtcgttccgttcggttaaccgttccg

SEQ ID NO: 345874 - DNA, 674 bp, Homo sapiens
  misc_feature: GZ8MTXP01BX535.45.36.D03.1.454.CMB.2.raw
  modified_base (202)..(202): a, c, t, g, unknown or other
  misc_feature (202)..(202): n is a, c, g, or t
  modified_base (416)..(416): a, c, t, g, unknown or other
  misc_feature (416)..(416): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgagggccagtaggagtgtcagtaagtacttaggctggtaaccaacgagaaacctggaccaggctcccaggcctcctcatccatcgatcgcactacccaaacgcgggtccctgggccctcccgaaggaccgtacgggttccgtggcccgagggttgggtcgtggggacctaagggtacgttcgactctccaccgtnacgcacgccgtggacgtccgtgtattgttaacgttttcggacttacggtttacttcgttcgtacgtacgcggtacggttcccggttcccgacccgtaccggccccgtccgttaccgtacccgggtttccgggggccggggggtaacccgtacgggggtgggaacggtgttacgggtaacggacggtaaacgtcgggttacggttccgttacgtaaccgaccgtaacgttcgttcgttacctttcgttaacgttccccg

SEQ ID NO: 345875 - DNA, 760 bp, Homo sapiens
  misc_feature: GZ8MTXP01AR9IE.45.36.D03.1.454.CMB.2.raw
  modified_base (201)..(201): a, c, t, g, unknown or other
  misc_feature (201)..(201): n is a, c, g, or t
  modified_base (359)..(359): a, c, t, g, unknown or other
  misc_feature (359)..(359): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagcccaccctctcctgcagggccagtaggagtgtcagtaagtacttaggctaggtaccaacagaaaccgtggccaaggcctcccgaggctcctcactccatgatcgacatccaaacgcgggtccctgggccgtacccagtacgtacggtttccggnggtccgtagggtcggtcgacgggtactaaggtacgttccacgtccgtaccgtaccgtacgacgcgtacggtccgtaggacgtcgtagtacgttgttacgtttcgtactttacgtttaccgttcgttcgtaccgtacggtaccggtaccggttcccgttacccgacccgtacccgtcccgttaccgttacccgggttacccgggggtttacccggggggacccgggggtaacggtacgggggtaacggtaacgggtaacggttaaacggggtaaaccggttaaccgggtaaacgggttcggggttaccgggttcccgttaacccgggtaaccccgttaccggttaaccgtttacccgtttaccggtttaccctttaacccgttaaccccgttttaacccccg

SEQ ID NO: 345876 - DNA, 549 bp, Homo sapiens
  misc_feature: GZ8MTXP01AW12S.45.36.D03.1.454.CMB.2.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaanagaaacngcagctccagctcnatccangangcatccaagcggtcccnggcnccagacaggttccccgnggcaggtggtctagggacngngtcactctcacgtcagcagctggancngtatgtatttgcttagtttacttctgtacagctacgtccgttccgccacgccgtactccgtacggttcggggccgggggtaccgaaggggtcggagacgttaggaagaacgttacgttggttcggcgtcgaacctaccagttccgtaagttcctttaaccg

SEQ ID NO: 345877 - DNA, 565 bp, Homo sapiens
  misc_feature: GZ8MTXP01CBXSH.45.36.D03.1.454.CMB.2.raw
  modified_base (496)..(496): a, c, t, g, unknown or other
  misc_feature (496)..(496): n is a, c, g, or t
  modified_base (533)..(533): a, c, t, g, unknown or other
  misc_feature (533)..(533): n is a, c, g, or t
  modified_base (556)..(556): a, c, t, g, unknown or other
  misc_feature (556)..(556): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggttccactgggtccgccaggttccaggcaaggggctggagtgggtggccctcatttccgaagatggaagtgagaaggcctactcagactccgtgaagggccgcttcaccatctccagagacaattccaagatgtcctctttttgactaaatgaatagcctgagagttgaggacacgtctgtctaatttctgtgccgagggggacagtctatgtagtcgtggttcgtagtagtaatcaaactactactacctcacgtggggacgtcgtgggacgaaagggacctcggcaccgtctccgcncgcctccaccgaacgggcccagtccgtcttcccccgnggcccgccctcgctccgaggacnccgcgtcgg

SEQ ID NO: 345878 - DNA, 553 bp, Homo sapiens
  misc_feature: GZ8MTXP01ACHIC.45.36.D03.1.454.CMB.2.raw
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggggggagacgagcccagcactggaagtcgccggtgttccttcggtgatcatcactgaacacagaggactcaccatggactttgggctgacctgggttttcctcgttgctcttttaagaggtgtccagtgtcaggtgcaggtggtggagtcgggggagcgttgtccagcctgggagtccctgagactctcctgtgcagcctctggattcgtccctcagtaactttggttccacgtgggtccnccaggttccaggcaaggggctggagtgggtgccctnatttccgaagntggaagtgagaacggcctatcagactccggtgaacgggccncttcacctatctccagacgacattcaagatgtcttcttttgactaatgaatagcctaggagaggttgacggtacacgtctgttacttatttcgtgtggcccggaagggggacatcttagtcgtagttcgttggttcgtaagtgtaatcaacttactaacttcctaacg

SEQ ID NO: 345879 - DNA, 626 bp, Homo sapiens
  misc_feature: GZ8MTXP01AJ0VB.45.36.D03.1.454.CMB.2.raw
  modified_base (445)..(445): a, c, t, g, unknown or other
  misc_feature (445)..(445): n is a, c, g, or t
  modified_base (552)..(552): a, c, t, g, unknown or other
  misc_feature (552)..(552): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagccaccctctcctgcaggccagtaggagtgtcagtaagtacttaggctggtaccaacagaacctggcaggctccagctcctcactccatgatgcactccaacgtacggggtcccctagggccgtaccccaggaccgtacggggtttcccgtgggaccctagggttgggggttcctggggggaaccctaagggtacgtttccgaacttccgtaccacccgtcgacgcgacgcccgtgggacnccgttgattgtatttgactagtttacttctgtcagcgacgtccgttccgcccgtaccggccgccgttcgtaccggtttcgggggaccgggggtacctgggggttagnggtaaggttcggaaggaccggtaagtcggttggccttcggaacccactgtcgttcgttacttccgctttccccg

SEQ ID NO: 345880 - DNA, 549 bp, Homo sapiens
  misc_feature: GZ8MTXP01D5BGC.45.36.D03.1.454.CMB.2.raw
  modified_base (336)..(336): a, c, t, g, unknown or other
  misc_feature (336)..(336): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagacgcgatcgacacgaccggtgctcgatttagctgcgtcacgatctctcttgggtttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgaagaaggcctactcagactccgtgaagggccgcttcaccatctccagagacaattccaagaatgtcctnttttgcaaatgaatagctgagagttgaggacacgtactgtcttaatttctgtgccctagggggacatctatgatcgtggttcgtagttagtaatcaactactactaacctcattgggggactgtggggcaaagggccctggtcacgtctccgcacgctcacagggcccagtccggtcttccccnggccgcctgctcccngacncaaccgtcgg

SEQ ID NO: 345881 - DNA, 675 bp, Homo sapiens
  misc_feature: GZ8MTXP01DAKSI.45.36.D03.1.454.CMB.2.raw
  modified_base (370)..(370): a, c, t, g, unknown or other
  misc_feature (370)..(370): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaaattgtgttgacacagtctccaggcaccctgtctctgtctccgaggggagacacgccaccctctcctgcgagggccaggtaggagtgtcaagtaagtacttaggctaggtaaccaacacgaaaccgtggaccaggcctacccgaggcctcctcactccatgatgacactaccaaacgtacgggtcccctgggccgtacccgagaccgtacgggttccgnggccgagggtcggggtcgtaggggactaaggtacgtttccacgtcctaccgaccgtcacgcacgccgtggacgtcgtgtattcggtattttcgtactttacgttttacttcgttacgtacgtacgtcgtaacggtcccgtttcccgaccgccgtcccgtccgttaccgttacccggggtttccgggggaccggggggtaaccgggtgggggtaggtaacggtacggttagggaacggaacggtacggtcgggttcggttcgttacgccgtacgtcgttcgtcgttaccgttccgttccgttcccg

SEQ ID NO: 345882 - DNA, 579 bp, Homo sapiens
  misc_feature: GZ8MTXP01APIXW.45.36.D03.1.454.CMB.2.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtactaggctaggtaccaacacgaaacctggaccaggcctcccgaggcctcctcactccatgatgcataccaacgacgggtcccctgggccctacccagacgtaggttccgnggccaggtgggtctaggggacaaggcgttcactcncaccgtnagcagctggacgctgatgtatttgacttagttacttntagtcacgcgacgtccgttccgaccgaccgcccgtcgtcgtaccggttcggggccggggggtaccgagggggtggaacggtggacggacggttacgtacggtggcgttcgacgaacgtactcgttgtcttactccttccgttcccg

SEQ ID NO: 345883 - DNA, 728 bp, Homo sapiens
  misc_feature: GZ8MTXP01CNZRN.45.36.D03.1.454.CMB.2.raw
  modified_base (305)..(305): a, c, t, g, unknown or other
  misc_feature (305)..(305): n is a, c, g, or t
  modified_base (445)..(445): a, c, t, g, unknown or other
  misc_feature (445)..(445): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcgagggccaggtaggagtgtacaaggttaagtacttaggcttaggtaccaacgagaaaccctggacccaggctcccaggcctccncatccatgatgcatacccaagcgggtcccctggcccgtaccaggactacgggttccgcgggtaccctagggttcgggtcgtacgggggaacctaaacgggtactttcccgaaaccgttccgtacccgtaacccccgggtnaaacgggtcccgacgtccccgttagggaaccgtcccgtagggtacttaggttagtttttacggctttaacggttttaccttcgtgtaccgtaaggtccggtaacggttcccggtttaccccgcccgtacccggtcccgtccgtccggttaaacccgggtttccgggggacccggggggtacccgtaagggggtcgggaaggtacggttagggaacgacgggtaaacgtcgggttacgcgttacggtccaacgtcttcgtgttaccttcttaaccgtttccccg

SEQ ID NO: 345884 - DNA, 610 bp, Homo sapiens
  misc_feature: GZ8MTXP01B33NJ.45.36.D03.1.454.CMB.2.raw
  modified_base (201)..(201): a, c, t, g, unknown or other
  misc_feature (201)..(201): n is a, c, g, or t
  modified_base (363)..(363): a, c, t, g, unknown or other
  misc_feature (363)..(363): n is a, c, g, or t
  modified_base (415)..(415): a, c, t, g, unknown or other
  misc_feature (415)..(415): n is a, c, g, or t
  modified_base (581)..(581): a, c, t, g, unknown or other
  misc_feature (581)..(581): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagccaccctctcctgcagggccaggtaggagtgtcagtaagtacttaggctggtaccaacagaaacctggaccagggctcccgaggcctcctcatccatgatcgcactaccccaacgtacggggtcccctgggccctccccgaggaccgtaggttcccgnggccgtaggtggggtcgtggggacaaggtacgttccacttcctcgacccgtnagcacgcgtggagctgatgtatttgcttacgtttcttctgtacagcgtaggtccgttccgccgaccgccgtcttccgtaccggtttcgggggccgggggtaccgtggggtcggaaggtagttacggacggttacgtaacggtcggttcggcgttcggcctaccgtnttcgtcgttccttccgttaactttccccg

SEQ ID NO: 345885 - DNA, 731 bp, Homo sapiens
  misc_feature: GZ8MTXP01DQYHX.45.36.D03.1.454.CMB.2.raw
  modified_base (199)..(199): a, c, t, g, unknown or other
  misc_feature (199)..(199): n is a, c, g, or t
  modified_base (261)..(261): a, c, t, g, unknown or other
  misc_feature (261)..(261): n is a, c, g, or t
  modified_base (353)..(353): a, c, t, g, unknown or other
  misc_feature (353)..(353): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccacggaaaattgtgttgacacagtctccaggcaccctgtctctgtctccgagggganacacgccaccctctcctgcgaggccagtaggagtgtacagtaagtacttaggctaggacaanagaaacctggccaggctcccgaggctcctcactcatgatcgacataccaacgacgggtccctgggccgtacccaggtaccgagggttcccgnggtacccgtagggtcggggtacgtagggggacctaaaggtacgtttccaaccgttcctacccgaaccggtcacggccgacggtcccgtaggggacctccgtaggtattaggttaacttttggacctttaaaggttttaccctccttagggttcaacggtccggtaacgggttccccggtttaccccgaccgttacccgggccccgtacttcccggttaaaccggggtttccgggggtaccgggggggaaccctaggggggttacgggaacggttagttaccggggtaaagacccgggtaaacgttggggttaccgggcttaccgggcctaaaccccggttcgttccggttcgttaccttccgttaacccgtttccccg

SEQ ID NO: 345886 - DNA, 702 bp, Homo sapiens
  misc_feature: GZ8MTXP01BZLK7.45.36.D03.1.454.CMB.2.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcgagggccaggtaggagtgtcaagtaagtacgttaggctaggtaccaanacgaaacctggcaggctccgagcctccncnctccatgatcgacactaccgaaacgtacgggtcccctgggcccgtcccgaggaccgtacggggtttcccggngggtccccgtaggggttcggggtcgtacgggggaacctaagggtacggttcccacgttcctacccgacccggtcacgggccgacgtcccgttagggctcgtgaacgtttgtagttttcggaccttaggttttactcgtaggtacaaggtccgtacggtccccgttccgacccgtaccgccgtccgtaccgtaccgggtttccgggggacggggtaccgtgggggtcgaaggtacttggggtaaacgacggtaaccggttggttccgggttccttcgggaacccctaacgggtcttcggttccgtttacctccgttaacctttcccccgg

SEQ ID NO: 345887 - DNA, 704 bp, Homo sapiens
  misc_feature: GZ8MTXP01C050C.45.36.D03.1.454.CMB.2.raw
  modified_base (199)..(199): a, c, t, g, unknown or other
  misc_feature (199)..(199): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaattgtgttgacacagtctccaggcaccctgtctctgtctccgaggggnacagccaccctctcctgcgagggccaggtaggagtgtacaagttaagtacttagggcttacgggtaaccaaacgaacggtaaaccgtcggcccgaacgggtcctaccccgaaggccttccctacactccagttagaactgaccacgtacccaaacgtacgggggtcccccttgggcccgtaccccgaaggaccgtacgggtttccgtggaccccgtaggttcggggtccgagggggactaaacgggttaagtccctaacgtccgtaccgacccgtacgagccaggtccgtggacgcctgtaatggtattttggacttagtttcttctggtactacgcgtacggtccgttacccgccgtaccgccgccttccggtaaccggtttccgggggacggggggtacccgtaaggggtgggaacggagttaggaacggacgtaacgtcggttcggcgttacggaacgtaacccgtttcgttcgttcgtttaccttaaccgttccgttcccg

SEQ ID NO: 345888 - DNA, 579 bp, Homo sapiens
  misc_feature: GZ8MTXP01CWRNM.45.36.D03.1.454.CMB.2.raw
  modified_base (186)..(186): a, c, t, g, unknown or other
  misc_feature (186)..(186): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
  modified_base (570)..(570): a, c, t, g, unknown or other
  misc_feature (570)..(570): n is a, c, g, or t
tcagacgcgatcgacacgaccggtgctcgatttagctgcgtcacgatctctcttgggtttggggggaagaggaagactgacggtcctcccaggagttcaggtgctgggcaccttgggcacgggggaggcgttgtccagcctgggaggtccctgagactctcctgtgcagcctctggattctccctnagttaactttggtttccactggtccnccaggttccaggcaaggggctggagtggtgccctnatttcgaantggaagtgagagcctatcagactccgtgaaggcgcttcaccatctccanagacaattccaagaatgtcctacttttgactaaatgaaatagcctgagtacgttgaggcacgtctagtcttnttctgtgtacgaggggacatctatgagtcttggttcgtagtagtaatctaactactactactactagtgggcgtgtacgggtacaaaggtccgtcggtcaccgtctccggcaacgccttaacccgaccaacgggccccttaagtcccggtcccttccccgcggcccgtccctcgtccctccgacggacgtccnccgtccggg

SEQ ID NO: 345889 - DNA, 541 bp, Homo sapiens
  misc_feature: GZ8MTXP01EXEUQ.45.36.D03.1.454.CMB.2.raw
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (477)..(477): a, c, t, g, unknown or other
  misc_feature (477)..(477): n is a, c, g, or t
  modified_base (533)..(533): a, c, t, g, unknown or other
  misc_feature (533)..(533): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatcccaancgggtccctgggcctcccagacaagttccgnggcccaggtgggtctggggacaagagttcactcncaccgtnagcagcctganctgatgtatttgctagtttactcgtgtacagtcgacgtccgttccgccgacgcccgctcgtaccgtttcggggcgggggtaccnggggtgaacgtgttggacgacgacgtggacggcttcgccactaattctgttcttcncgttcccg

SEQ ID NO: 345890 - DNA, 699 bp, Homo sapiens
  misc_feature: GZ8MTXP01DLBZ2.45.36.D03.1.454.CMB.2.raw
  modified_base (382)..(382): a, c, t, g, unknown or other
  misc_feature (382)..(382): n is a, c, g, or t
tcagacgcgatcgacacgaccggtgctcgatttagctgcgtcacgatctctcttggggggccctggggaggaactgctcagttaggacccagagggaaccatggaagccccagctcagcttctcttcctcctgctactctggctcccagataccaaccggaaaattgtgttgacacagtctccaggcaccctgtctctgtctccgaggggagacacgccaccctctcctgcgagggccaggtaggagtgtcagtaagtacttaggctaggtaaccaaactacgaaacctggacccaagggcctacccgaggcctcctacactccatgatgaccataccgaaacgcgggtcctggccgtcccaggacgacgggtttcccccgnggacgagggttcggggtcgtaagggggaactggtacggtttccaaccgttccgtaccgaacccgggtcaacgggccaacggtcccgtaggggaccgtcctaggtacttaggttattttcggcttagttttactcgttagtcgaagtcgtacggtcccgttcccggaccccgccggtccgtccgttccggtaccggggttccgggggaccgggggtaacgggtaaggggtaggacggtaggttacggaaacggtaacggttacggttgggttacggccgtacgtaaccgtaccgtcgttccgttccgttccttaaccg

SEQ ID NO: 345891 - DNA, 604 bp, Homo sapiens
  misc_feature: GZ8MTXP01BNCWJ.45.36.D03.1.454.CMB.2.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
  modified_base (583)..(583): a, c, t, g, unknown or other
  misc_feature (583)..(583): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctccncatccatgatgcatccaacgngggtccccnggccgtccagacacggttccgnggccctagggtggggtctggggacctaagtacgttcgactctacgaccgtcacgcacgcccgtggacgtcctgaagttgtaacttttggacttacggttttacttcgtagttcaggcgtacggtcccgttccgcccgtaccgcccgtcgttccgtaaccgggtttccgggggaccggggggtacctgggggtaggaaggacgttgggagacgtaacgtggagggttccaggcccaacgtntcgtcgttactcgcttccccg

SEQ ID NO: 345892 - DNA, 672 bp, Homo sapiens
  misc_feature: GZ8MTXP01AQ6C5.45.36.D03.1.454.CMB.2.raw
  modified_base (210)..(210): a, c, t, g, unknown or other
  misc_feature (210)..(210): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcgagggccaggtaggagtgtcagtaagtacttaggctacggtaccaanacgaaacnggaccaggcctcccgaggcctcctcactccatgatgacctatccgaacgcgggtcccgtggccgtcccagtacgtacggttcccggtacggcgtagggttcggggtcgtaaggggacctaaggtacgtttccaccgtcctaccgtacccggtacacgtccgaaggtcccgtgggaaccgtccttggtaaattcggttaattttcggacgtttaacgtttcttcgtgtacgacgtcgtacgtcccgttccgccctaccggccgtccgtccgttaccggtttccggggggccgggggtaaccgtgggggacggagtcggttacgggaaacgtaccggagttcggttacgggccctagggccctacgtcgttcgttaacgttcccttaacg

SEQ ID NO: 345893 - DNA, 730 bp, Homo sapiens
  misc_feature: GZ8MTXP01D291T.45.36.D03.1.454.CMB.2.raw
  modified_base (204)..(204): a, c, t, g, unknown or other
  misc_feature (204)..(204): n is a, c, g, or t
  modified_base (632)..(632): a, c, t, g, unknown or other
  misc_feature (632)..(632): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccacctctcctgcgagggccaggtaggagtgtcagtaagtacttaggctaggtaacaacagaacctggccaggcctcccgagcctcctcactccatgatcgacactacccgaaacgtcggggtcccctgggccccgtacccgaggtaccgtacggggttcccggtaggggaccctacgggggttcgggggtacgtggggaaccgtaacggtacgtttcccgactttccgtaccctacccggtacgaacgggccgtacggtcccgttagggacgtcccgtaggtaagttggtttaagtttttcgaacgtttacggttttaaccttcgttacgttacgaccgtcgggttaacggttccgttaccccgccgtaaccggtcccgtacttcccgggttacggtttccggggggccggggttaaccgngggggttggaacgttaggacgggaacggttacggagttcggggttacgttcttacggaaccgtaactgtttcccgtgtttaccttcgaacctttcccg

SEQ ID NO: 345894 - DNA, 793 bp, Homo sapiens
  misc_feature: GZ8MTXP01DPXJU.45.36.D03.1.454.CMB.2.raw
  modified_base (293)..(293): a, c, t, g, unknown or other
  misc_feature (293)..(293): n is a, c, g, or t
  modified_base (362)..(362): a, c, t, g, unknown or other
  misc_feature (362)..(362): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtacagtaagtacttaggctaggtaccaacagaaacctggccaggctccaggctccncatccatgatcgcactacccaaacgcgggtcccctgggcctaccccgagtaccgtacggggtttcccgnggccccgtagggttcgggggtccgtagggggtaaccctaaaggggtaacgtttcccgaactttacccgtaccgtaaaccccggtcgaacggtcccgaacgggtccccgttaggggaaccgtcccggtaggtaagttacgggtttaaagttttttcgggaaccctttaaacgggttttttacccttcgtttacggttaccgaacgggtaccggtaacggggtttccccggtttccccggaccccgtaaccggtcccccggtacctttacccggttaacccggggttttccggggggaccggggggggttaacccgaggggggttacggaagggtaagttcggggaacggaaacgtaaccggttgggttaccgggcgttcgggaacctaaacccgttcgttccgttcgttacctttaaccgttccgttccccg

SEQ ID NO: 345895 - DNA, 663 bp, Homo sapiens
  misc_feature: GZ8MTXP01DH06M.45.36.D03.1.454.CMB.2.raw
  modified_base (293)..(293): a, c, t, g, unknown or other
  misc_feature (293)..(293): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccacggaaaaattgtgttgacacagtctccaggcaccctgtctctgtctccgaggggagacagcccaccctctcctgcagggccagtaggagtgtcagtaagtacttaggctaggtaccaacagaaacctggccaggctcccaggcctccncactccatgatgactactaccaaacgacggggtcccctgggcccgtacccgagaccgtaggttcccgtggcctagggtcgggtcgtggggaactaaggtacgttcgactcgtaccgaaccgtcaacggcacgccgtggacgtccgtagtagttgtaagttttgacgttacgttttacttacgttgtactacgtacggtacggtcccgttacccgcccgtaccgcccgtccgttaccgtacccggtttccgggggaccgggggtaccgagggggtcggaaggtagttcgggaacgacggtaaacgtcgggttacggccgttggcctaaccgtaacgttccgttcggttccttccgttaacgttttcccccg

SEQ ID NO: 345896 - DNA, 840 bp, Homo sapiens
  misc_feature: GZ8MTXP01BPH30.45.36.D03.1.454.CMB.2.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggganacncgccaccctctcctgcgagggccaggtaggagtgtcaagtaagtacttaggctaggtaccaacagaaacctggaccaggcctacccgaggcctcctcactccaattcggaatcgacctactacccgaaacgacgggttcccctagggccctaccccgaggtaaccgtacggggtttacccggtgggaccccgtacgggtggggggttacccgtaggggggaacctaaaacgggtacggtttcccaaccgtttccgtacccgtaaccccggttacaacggcccgtaaggtccccggttagggaaccgtcccggtaggtacgtttggtttaacgttttttacgggtaccttaacgggtttttaccttccgttaagggtacccgtaacggtcccggaaacgggtttccccggtttaccccgggaccccttacccgggccccggttccttaaccggttacccggggttttccccggggggaccgggggggttaacccgaggggggtttaccgggaacggttaagggttccgggaaaaggttacccggtaaacgggttcgggttaccgggttccgttacggaacccgtaaccctaacggtttccgtcggtttacccgtttcccgttaactttccccccgg

SEQ ID NO: 345897 - DNA, 673 bp, Homo sapiens
  misc_feature: GZ8MTXP01BTZ7M.45.36.D03.1.454.CMB.2.raw
  modified_base (210)..(210): a, c, t, g, unknown or other
  misc_feature (210)..(210): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccacctctcctgcagggccaggtaggagtgtacagtaagtattaggctaggtaaccaacgagaaaccgtggaccgacggcctacccgaggtcctccctcactccatgatcgacataccaacgacgggtccctggcctaccagacgtcggttccccgtggcgtagggtcggggtctaacgggggaactaaggtacgttaccacttccgtccgtacccgtcacgccgacgtccgtagggactccgtagtaacgttgttaagtttcggtacttacggtttacttcgtcggttacaacggtcgtacgtcccgttccgacccgccgtccgcccgttcgtaccgggtttccgggggaccgggggttaccggaagggggttcggaggtaggttacggtaacggaccggttaacgttgggttacgggtctacggcctaacccggttcgttccgttcgttccgttccg

SEQ ID NO: 345898 - DNA, 668 bp, Homo sapiens
  misc_feature: GZ8MTXP01EP7DT.45.36.D03.1.454.CMB.2.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (650)..(650): a, c, t, g, unknown or other
  misc_feature (650)..(650): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccacctctctgcgagggccagtaggatgtacagtaagtactaggctaggtaccaacagaaactggccaggctcccagctcncatccatcgatgaccactacccaaacgtcggggttacccctgggcccgtaccccgaggtaccgtaacggggttccccggtggaccgtacggggttcgggggtaccgtagggggaaccctaaagggtaacttttcccgacccttccgtacccggaaccccgtccgaaaggtccaacgggtcccgttaggggaacctcgtagtaagttgttaagtttttcgaccgttagtttccttcgtgttacgacgcgtacgtcccggttccaccgtaccgcccgtcttacccgtacggggtttccgggggcggggaccggtagggtgggaagttcgagggacgacgtacgtggttcggcttacgcaccgtntcgtcgcttcgcttcccg

SEQ ID NO: 345899 - DNA, 700 bp, Homo sapiens
  misc_feature: GZ8MTXP01AR1LY.45.36.D03.1.454.CMB.2.raw
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (408)..(408): a, c, t, g, unknown or other
  misc_feature (408)..(408): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggccaccccgtntctgtctccgagggganacacgcccaccctctcctgcagggccagtaggagtgtacagtaagtacttaggctaggtaaccaacacgaaacctggaccacggcctcccgaggtcctacctacactaccatcgatcggactactaccgaacggtaccggtccgtcgcccgtacgacgtacggtacggtcgcggacgtcgggtcggtgacggagtacgtacttccnctcctaccgtacctacgagaccgcgtccggtagctcgtagtcgttagttacgtttacgtacttttagtttcgtacgtcgttagaacgtcgttaaccggggttcccgtacccgccgaccgtccgtacccggtcggtttacccgggggttcggggggaccgggtaacggggtagggtacgacggtcggttaacgggacgttaaaccgggttgggtcgggtaccggttcgccggttaaccctcggttctttccggttcgttacccttacgtaaccccgttttccccggaaccccg

SEQ ID NO: 345900 - DNA, 690 bp, Homo sapiens
  misc_feature: GZ8MTXP01EHS0Z.45.36.D03.1.454.CMB.2.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctcccagataccaccggaaaattgtgttgacacagtctccaggcaccctgtctctgtctccgagggganacagcccaccctctcctgcagggccaggtaggagtgtcagtaagtacttaggctggtaaccaacagaaacctggccaggctcccgaggctcctcatccatgatgcactccaaacgngggtcccctggccgtcccaggtacctagggttcccgtaggcccgtagggttggggtcgtggggaccctaaggacgtttccacgtccgtaccgacccggtcaacggccacgtcccgttagggacgtcccgtgtaacgttgtaacgtttttcgacgttaacggttttaccttccgttagttccgaaggtccggtacggtacccggtttcccgcccgtaacccgccccgtcgttcccgttaaccgggtttccgggggaccggggggtacccgtgggggttcgggaagtacggttagggaacggttacggtaaacggtgggcggttacgttcggaaccacctaacgttcgttcgttccttaaccttcgtttccccg

SEQ ID NO: 345901 - DNA, 562 bp, Homo sapiens
  misc_feature: GZ8MTXP01ALN9R.45.36.D03.1.454.CMB.2.raw
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaacagaaacctggccaggctcccgaggcctcctcatccatgatgcatccaagcggtcccnggcctccagacaggttccgnggcccaggtgggtctgggacaagngttcactctcacgtcagcacgccctggacncctgattggtatttgcttagtttacttcnggttcagctaggtcccgttccgccccgtacgcccggtctccggtaccggtttcgggggccgggggacctagggggtgaagtagttgggacgacgtagtgacgggttcnggccnccgaatcctggttctcgcgtttcccg

SEQ ID NO: 345902 - DNA, 742 bp, Homo sapiens
  misc_feature: GZ8MTXP01D6QQN.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctccagataccacggaaaaattgtgttgacacagtctccaggcaccctgtctctgtctccgagggganacagccaccctctcctgcagggccaggtaggagtgtacagtaagtactaggctggaacaanagaaacctggcaggctccgagctcncatcatgntcgacactacccgaaacgtacgggtccctcgggccgtaccgaaggtaccgtcggggttaccggtggaccgtagggttcggggtcggtacgggaaccaagggtacgtttccaccttccgtacccgaccggtacgaagccgtacggtccccgttaggggacctcccggttagtaagttcggtttaaacgtttttcgggaacctttaacggtttttccttaccgtgttaccgtaacggtccggtaaacggtttcccggttacccggcccgtaccccgggtcccgttcccgtttaccggttaacccgggggttttccggggggaaccgggggggttaaccgtagggggttggaaacgggtaacgttgggaaaccgggttacgtaaaccggttgggacgggttcacgggaaccctaactcgttcgtcgttaccttcttcggtttaaccccg

SEQ ID NO: 345903 - DNA, 647 bp, Homo sapiens
  misc_feature: GZ8MTXP01D7B4W.45.36.D03.1.454.CMB.2.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
  modified_base (517)..(517): a, c, t, g, unknown or other
  misc_feature (517)..(517): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctcaggcaccctgtctctgtctccgagggganacagtccaccctctcctgcagggccagtaggagtgtcagtaagtacttaggctaggtacaanagaaccnggcagctccagctccncatccatgatcgactactaccaacgacgggtcccnggcctacccaggtacgtcggtttccccgnggctagggtcgggtcgtaaggggaactaaggtactttcccgaacttccgtaccgaccgtcaacggccagtcccgtagggacgtccgtaggtaacttgttaactttgaccttagtttacttcgtacggtactaacggtcgttaaccgtcccggttcccnccgtacgtcccgtacgttcgtccggggtttcgggggaccgggggtacaagggggtgaggtacgttaggggaacgtacggttacgttcggacggtcacggaacctacgtcgttcgtaacgtttctaacccg

SEQ ID NO: 345904 - DNA, 757 bp, Homo sapiens
  misc_feature: GZ8MTXP01BU7Q5.45.36.D03.1.454.CMB.2.raw
  modified_base (276)..(276): a, c, t, g, unknown or other
  misc_feature (276)..(276): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgaccttgggttttcctcgttgctcttttaagaggtgtccagtgtcaggtgcgagggtggtgggaggtcggggggagcgttgtccaggccgtggggacgtccctgagtactctcctgtgcagcctntggatcctcctctagttaacctttggttcccacgtcgggtcccgccgtagggttcccagggccgaagggggctaggggaggtcgggggtcggccccgttactagtttccggaaaggtagtcggggaaaggtggaacggaacgggcccttaaacgtccgaacggtaccgttacccggggtagggaaaccgggggtcccctacgtttaccgaaccctacgttcctacccgaaggtaacgtaaccctaaattaaccccgaaaaggttaaacttccggtttaccctttacgtttttacggaaccttaaaacgttaggggtaaaacgttaccggtaccgttaggtaaacggtaggtttacggaacgggtaacccgtacgttccgttacgttacgtttaacgttttcgtcggtttcgggacccggttagggggactagttcgttagttggtaagttcgtcggttcgtagttacgtaacttcttaaac

SEQ ID NO: 345905 - DNA, 694 bp, Homo sapiens
  misc_feature: GZ8MTXP01AWVI9.45.36.D03.1.454.CMB.2.raw
  modified_base (211)..(211): a, c, t, g, unknown or other
  misc_feature (211)..(211): n is a, c, g, or t
  modified_base (409)..(409): a, c, t, g, unknown or other
  misc_feature (409)..(409): n is a, c, g, or t
  modified_base (610)..(610): a, c, t, g, unknown or other
  misc_feature (610)..(610): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggccaccctgtctctgtctccgagggganacacgccaccctctcctgcgagggccaggtaggagtgtactaggtaagtacgttaggctaggtaaccaagacgaaactggaccaggcctaccgaggcctacctcactccatgatcgacactaccaacgtacggtccctggccgtacccaggtaccgtacggttccccgaggcgtagggtcgggtcgtaaggggaaccngggtactttccgacgttcctaccgtaccgtacgacggtaccgacggtaccgttagggaaccgtcccgtaggttaacgttacgtttagttttcggactttacgtttaccgttcgttagtacgtaacgtcgtacgtcccgttaccggaccctacgtcccgtccgttaccggtaccgggtttccgggggaccgggggtaccggnggggttacggagtacggacggtacggtaacggttacgttgggacggtcgtcgaaccgttacgtcgttcgttcgttcgttaaccg

SEQ ID NO: 345906 - DNA, 670 bp, Homo sapiens
  misc_feature: GZ8MTXP01BEC2G.45.36.D03.1.454.CMB.2.raw
  modified_base (201)..(201): a, c, t, g, unknown or other
  misc_feature (201)..(201): n is a, c, g, or t
  modified_base (338)..(338): a, c, t, g, unknown or other
  misc_feature (338)..(338): n is a, c, g, or t
  modified_base (437)..(437): a, c, t, g, unknown or other
  misc_feature (437)..(437): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcgagggccaggtaggagtgtcaagtaagtacttaggctaggtaccaacgagaaacctggacccaggcctacccgaggcctcctcatccatgatcgctactacccaacgacgggtccccngggccgtacccaggtacgtacggggttccgtgggaccctagggttcggggtcgtggggaacaaagggttacgttccaccgtccgtaccgtaccccggtnacggtccgaacgggtcctaggggctccgtggtacgttagttagtttttcggactttaggtttccttcgtgttacgaggcgtacggtcccggttacccgcccggaccgtcccgtctccggtaccggtttcgggggccggggggtacagggggttggaacgtaggttaggacgaggtacgtggttaggttccttggccaccttgttcctggttcccttaattaaccgtttccccg

SEQ ID NO: 345907 - DNA, 616 bp, Homo sapiens
  misc_feature: GZ8MTXP01B9U8J.45.36.D03.1.454.CMB.2.raw
  modified_base (319)..(319): a, c, t, g, unknown or other
  misc_feature (319)..(319): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtactaggctggtacaacagaaacctgccaggctcccaggctcctcatccatgatgcataccaacacgggtccccngggcctccccagaccaggttccgtggcccgaggtgggtctaggggacaagtaacggtttcaacgtccctctacccggcaggccagcccgtggacgcctgtatgtattttcgctaggttttactcgtgtactacggtctacggtcgtttcccgccgtaaccgcccgtctccgttaaccgtttcggggaccgggggtaccgaggggttggaaggaagttgggacggttaccgaaacgttggttcgggacgttcggaacctaccgtaattccgtggttcctttaaccgaactttccccgg

SEQ ID NO: 345908 - DNA, 617 bp, Homo sapiens
  misc_feature: GZ8MTXP01BGC3W.45.36.D03.1.454.CMB.2.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
tcagacgcgatcgacacgaccggtgctcgatttagctgcgtcacgatctctcttgggtttggggggaagatgaagactgacggtcctcccaggagttcaggtgctgggcaccttgggcacggggggaggcgttgtccagcctgggaggtccctgagactctcctgtgcagcctctggattctccctcagttaactttggttccactgtcgtccgccaggttccaggcaaggggctggagtgggtgccctnattcgaagatggaagtgagaggcctactcagacnccgtgaacgggccgcttcaccatctccagagacaattccaaagtaatcgtccttcttttgactaaatgaatagcctagagtagttgagacaacgttctgtctatttctgtcgaccgagggggactatctagtgtagttcgtggtttacgtagttagtaatacaaacttactacttacctcgtagttggacgttcggtaggggacgtaaacgggtccttacggtcctaccgtcctccgctaacgtccttaccgaaccgaacgggtcccctaagttcccggttccttcccccgtggcccgtaacccgttcgccttccgaacggttaacgtccccg

SEQ ID NO: 345909 - DNA, 824 bp, Homo sapiens
  misc_feature: GZ8MTXP01BME0K.45.36.D03.1.454.CMB.2.raw
  modified_base (210)..(210): a, c, t, g, unknown or other
  misc_feature (210)..(210): n is a, c, g, or t
  modified_base (799)..(799): a, c, t, g, unknown or other
  misc_feature (799)..(799): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcaggccagtaggagtgtcagtaagtacgttaggctaggtaccaacgacgaaactcggaccgaggcctacccgaggtcctaccctacactcccaagtgaacttcgacctaacgtaccccgaaacggtacccggggttccccgtacggggtacccgttacccccgaaaggtaccgtacggggttttcccccggcggggtacgtaggggttcgggggtaccggttaacgggggaacaacgggttacgtttacccgaaccgtttccgtacccggtacccggtacgaacgtccgacgggtcccgtaggggtaaccgtcccggttaggttaaaccgttttgggtttaattttttccggaacgtttaaacgggttttttaccttcgtttacggttaacgacggttacgtaaccggttccccgggtttaccccggaccctacccgggtccgttcccggttacgttaacccgggggtttccggggggacccggggggtaaccgtaaggggttcggaaggtacgttacgggaacgtaaccgggttaacgttcgggttcgggaacttccgggcttaaaccgngtttcccgtgtttaacccttaaccg

SEQ ID NO: 345910 - DNA, 574 bp, Homo sapiens
  misc_feature: GZ8MTXP01BSMI2.45.36.D03.1.454.CMB.2.raw
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttggggggggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggagcgttgtccagcctgggagtccctgagctctcctgtgcagcctntggattctccctnagtactttggttccacgtgggtccgcaggttccaggcgaggggctggngtgggtgccctnatttccgaagntggaagtgagacggcctancagactccgtgaacgggcccncttcaccatcaccagagactaataccaagattcgtaccttcttttagactaaatgaatacgctgggagtagttagacggtactacgtcgtgtctattctgtcgccggaagggggtcagtcttagtaggtagttcgttcgggttacgttaagtagttaacttactaacttacttaaccgttaacctaacg

SEQ ID NO: 345911 - DNA, 591 bp, Homo sapiens
  misc_feature: GZ8MTXP01D526Y.45.36.D03.1.454.CMB.2.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggtgtgtcacaagatttgggctctgggcaccgtgggcagtgggggagcgttgtccagcctgggaggtccctgagactctcctgtgcagcctctggattctccctnagttaactttggttccatggtccncaggttccaggcaagggctggagtgggtgcccncattccgaagatggaagtgagaaggcctactcagactccgtgaaggcgcttcaccatctccagagaccaattcaagatgtcctnttttgctaaatgaatagctgagagttgaggacacgtctgtacttatttctgtgcgagggganagtctaatgagttcgtggttcgtagtagtaactactaaactactactacctcaagttcgggaaacgttcgtacgggggacttaaaacgggggttcccttacgggtaacccgtaaccgttcctcccggacttacggtcctttaacccgaaacccggg

SEQ ID NO: 345912 - DNA, 717 bp, Homo sapiens
  misc_feature: GZ8MTXP01D2HGI.45.36.D03.1.454.CMB.2.raw
  modified_base (204)..(204): a, c, t, g, unknown or other
  misc_feature (204)..(204): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccgggcaccctgtctctgtcctccgagggganacacgccaccctctcctgcagggccaggtaggagtgtacagtaagtacgttaggctacggtaaccaacgaagaaaccgtggaccaggcctcccgaggcctcctcactccatgatgcatccgaacgcggtccctggccctccgagcgtacggtcgtgcgacggtggtcgtggacngtaaacgtcctcnctaccgaccgtcgagccgacgtcccgtagggacgtccgtgtagttagtttagttttacggacttttaagttttaccgtgttacgtacgtaacgtccgtaaccggggttccccgtttacccggaccccgacccggtcccgttaccgtacccggttaccggggtttacccggggggaccggggggtaaccgttagggggtcggaaagggttaaggtcgggaaacgggtacccggttaaaggtcgggtaacggccgttcggaacccgttaaacccgttcgtttaaccgttccgttcccttaccgttaaccccgttccccggttaacccg

SEQ ID NO: 345913 - DNA, 644 bp, Homo sapiens
  misc_feature: GZ8MTXP01C9WIZ.45.36.D03.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (387)..(387): a, c, t, g, unknown or other
  misc_feature (387)..(387): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctcccagataccaccggaaaattgtgttgacacagtctccaggcaccctgtctctgtctccgagggganacagcccaccctctcctgcagggccaggtaggagtgtcagtaagtacttaggctagtaccaacgagaacctggccaggctcccaggctccncactccatgatgcactcccaaacgcgggtcccctgggcctccagacgtagggttccgtggccgagggtgggtcgtgggacaagagttcacgtcnccaccgtcagcagccgtggacgtctgtatagtacttttggacttacggtttacttctcgttctacgcgtacggtcccgttcccgacccgtaccgcccgtccttaccggtacccgggtttccgggggaccggggggtacccggtacgggggtgggtaaggtacggttagggaacggaccggtaaacgggtttcgggttacgggttcgttcgggcctaaccgtcgtttcgtcggtttctttaacccgttcctttccccg

SEQ ID NO: 345914 - DNA, 733 bp, Homo sapiens
  misc_feature: GZ8MTXP01BF9QP.45.36.D03.1.454.CMB.2.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcagggccaggtaggagtgtcaagtaagtacgttaggctaggaacaacgacgaaaccgtggaccaggctacccgaggcctcctcactccagtgaatcgactactacccgaaacgtccggggtcccctcgggccgtacccgagtaccgtacgggtttcccggagggtacccgtaggggttcggggtaccggtacgggggtaactaacgggttacgtttcccgaacttcccgtacccgtaccccggtcacgggcctaacggcccgttggggacgtccgtagtaagttgttaacgtttttcggactttaggttttacctcgtacgtacgtaacgcggtcggttcccggttaccccgccgttacccgcccgtccttccggtaaccggggtttccgggggaccgggggtaacgtagggggttcggaacggtacggttagggaacggacggtaacgttcgggacggcgttccggaactacccggttcgttccggttcttaccgttcgttccgttcccg

SEQ ID NO: 345915 - DNA, 809 bp, Homo sapiens
  misc_feature: GZ8MTXP01EIV2U.45.36.D03.1.454.CMB.2.raw
  modified_base (230)..(230): a, c, t, g, unknown or other
  misc_feature (230)..(230): n is a, c, g, or t
  modified_base (437)..(437): a, c, t, g, unknown or other
  misc_feature (437)..(437): n is a, c, g, or t
tcagacgcgatcgacacgaccggtgctcgatttagctgcgtcacgatctctcttggggggccctggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacacgccaccctctccngcgagggccaggtaggagtgtacaagtaagtacttagggctacggtaaccaaacgaacgaaaacccgtggacccgacgggtcctaccccgaagggtcccctcccctacaactcccagtacgattcgacctaactaccccgaaacgtcccgggggttacccctgggggacccgttccccgaaggtaaccgtacgggtttcccccgggngggtacgtaggggttcgggtacggtaacgggactaaggtacgttacctaccgtccgtaccgtaccggtacacggtcgtacggtccggtaggactaccgttagtacgtttacgtttacgtttcgtactttacgttttacttcgtacgtaccggtacgggtccgtaccggttcccggttaccccgacccgtaccccggtcccgttaccgttaccgggttacccgggggttaccggggggaccgggggtaaccggtaagggggtcggttaaagggtacggttaacgggaaacggtaaccgggttaacggttcgggttaccgggtcgtaacggtaacccgttaacgtacgttccggttcccgtttaaccgttaacg

SEQ ID NO: 345916 - DNA, 628 bp, Homo sapiens
  misc_feature: GZ8MTXP01DHWKB.45.36.D03.1.454.CMB.2.raw
  modified_base (212)..(212): a, c, t, g, unknown or other
  misc_feature (212)..(212): n is a, c, g, or t
  modified_base (365)..(365): a, c, t, g, unknown or other
  misc_feature (365)..(365): n is a, c, g, or t
  modified_base (553)..(553): a, c, t, g, unknown or other
  misc_feature (553)..(553): n is a, c, g, or t
tcagacgcgatcgacacgaccggtgctcgatttagctgcgtcacgatctctcttgggggccctggggaggaactgctcagttaggacccagagggaaccatggaagccccagctcagctttctcttcctcctgctactctggctcccagataccaccggaaaaattgtgttgacacagtctccaggcaccctgtctctgtctccgagggganacacgcccaccctctcctcgcgacgggccagtaggagtgtcagtaagtacttaggctaggtaccaacagaactggcaggctccaggcctcctcatccatgatcgacactccgaaacgtcgggtccctgggcctccaggacctcgggttcccgnggcgagggttggggtctaggggaacctggtacgtttccaccgttcttacgaccgtcacgcacgtccgtgggacgtcctgtaacgttgttactttcgtacttaacgttttcttcgtgttcgaggtcgtacgtccgttaccgcccgacgtcccgcgttccgtacggtttccgggggccgggggtaaccgnggggtacggagtacggttggaaggtacgttacggttggttcggtcgcgcgtacctggttccttcgttcgttaacg

SEQ ID NO: 345917 - DNA, 702 bp, Homo sapiens
  misc_feature: GZ8MTXP01BIIPP.45.36.D03.1.454.CMB.2.raw
  modified_base (204)..(204): a, c, t, g, unknown or other
  misc_feature (204)..(204): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (598)..(598): a, c, t, g, unknown or other
  misc_feature (598)..(598): n is a, c, g, or t
  modified_base (667)..(667): a, c, t, g, unknown or other
  misc_feature (667)..(667): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcgagggccaggtaggagtgtacaaggttaagttacttagggcctagggtaaccaacgaagaaacctggcccaaggcctcccaggcctcctcactccatgatcgcactccgaaacgtacgggtccccngggtcccgtccgagaccgtacgggttccggnggccgtaggggttcggggtcgtcgggggtaactaacgggtacgtttcaccgttccgtaccgacccggtacaagggccacgtccgttaggacgtccgtgtactttgtaacgtttttgttacgttttacgtcgttcgtacgtagtccgtcgggtcccggttcccgccccgacggtcccgtcgtcccgttaggtttccgggggccggggtcgtaaccgggnggggtcgaagggtacttaggggaacgaacggtaacggtgggttcgggcttaccgggtcctaacccggtntttccgtaggtttccctaacttaaccgtttccccg

SEQ ID NO: 345918 - DNA, 665 bp, Homo sapiens
  misc_feature: GZ8MTXP01ELGWK.45.36.D03.1.454.CMB.2.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggcaccctgtctctgtctccgagggganacagccacctctcctgcgagggccagtaggagtgtacagtaagtactaggctaggacaacagaacctggacaggctccaggcctcctcatcatgatgcactaccgaacgtacgggtcccnggcctacccaggtaccgtacggttccgtggccccgtagggtgggtcgtaggggaactaaggtacgttcaccgttcnccgtaacccggtnacgcacgtccgtggacgtctagtattagtttatttcgtacgtttactttacttcgtacgtacgacggtacggtaccggttccggttacccgacccgtacccggcccgttccgttaccgggttaccggggtttaccgggggaccgggggtacggtaggggtacggaaggtacggttagggaacggacggtacggtcggttcggcgttcgtaaccgtacgtaagttccgttacgttccttaaccgttccgttcccg

SEQ ID NO: 345919 - DNA, 775 bp, Homo sapiens
  misc_feature: GZ8MTXP01DXDXB.45.36.D03.1.454.CMB.2.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtactaggctaggaccaacagaaacctggccaggctcccaggcctcctcactccatgatcgacactaccaaacgcgggggttcccctgggaccgtccccaaggtacctacggggtttcccgtgggccccgtaggggttcgggggtctacgggggaaccctaaggtaacggtttccaacgtttccgtacccgaacccggttccaacggggtcccaacgggtccccgtaggggaacctcccgtagtacgttaggtttaacgtttttacgccgtttaacgtttttaaccttcgttcggttacaacgtccggttaccggttcccggtttacccccggaccttaccccggccccggttcgtttaccggttaaccccggggttttccggggggaacccgggggggtaacccgtaagggggttggggaaaccgtcggttagggaaacggttaccggtaaaccgttggggttccgggttcttccgggtaacctccgtaagttccccgttggttaccttcccggttaacgtttcccccg

SEQ ID NO: 345920 - DNA, 593 bp, Homo sapiens
  misc_feature: GZ8MTXP01BJ6J2.45.36.D03.1.454.CMB.2.raw
  modified_base (202)..(202): a, c, t, g, unknown or other
  misc_feature (202)..(202): n is a, c, g, or t
  modified_base (344)..(344): a, c, t, g, unknown or other
  misc_feature (344)..(344): n is a, c, g, or t
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (457)..(457): a, c, t, g, unknown or other
  misc_feature (457)..(457): n is a, c, g, or t
  modified_base (568)..(568): a, c, t, g, unknown or other
  misc_feature (568)..(568): n is a, c, g, or t
  modified_base (584)..(584): a, c, t, g, unknown or other
  misc_feature (584)..(584): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggganacagcccaccctctcctgcagggccagtaggagtgtcagtaagtacttaggctaggtacaacagaaacctggcaggctccagctcctcatccatgatgcactccaacgcgggtccctgggccgtccgagtactaggttccgnggccaggtgggtctggggacaagtagttcactctcaccgtnagcagccgtgacgtcgngtactgttatttgacttagtttacttcgtagtctacgcgtacgtccggttccccnccgaccgtcccgccttaccgtacgggtttccggggccggggggtaccgtagggggtcggaaggtagttagggaacgacggtaacggtgttacgggcttcggaacctacgtnttcggtcttcttaacncgtttcccc

SEQ ID NO: 345921 - DNA, 815 bp, Homo sapiens
  misc_feature: GZ8MTXP01CMA9V.45.36.D03.1.454.CMB.2.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaaccggaaaaattgtgttgacacagtctccaggccaccctgtctctgtctccgagggganacacgcccaccctctcctgcgacgggccaggtaggagtgtacgtaagtaagttacgttagggcttacgggtaaccaaacgaacggaaaacccgtcggacccgaacgggccctaccccgacggtcctccctacactaccaatcggactcgacctaactacccgaaacggtaccggggtccccgtacgggtacccgtacccgacggtaaccggtaccggggtttccggtagggtaccccggtagggggttcgggggtcgtacggggggtaactaacgggttaaccgtttccaaccgtttacccgtacccggtaaccccgtcgaacggtccgaaccggtcccgttagggaccgtcccgttaggtaccgtttaggttaacgttttttcgacgtttaacggttttacctcgttacgtacgtacgttccgggtaacggttccccgttaccccgcccgtaccggtccccgtccgttaccggttacccggggttccggggggacccgggggtaccgtagggggtcggaacggtagttacgggaacgacggtaacggtgggttcggttcttacggtaaccctacgtcttccggtcgttcttaacccgttccgtttccccg

SEQ ID NO: 345922 - DNA, 686 bp, Homo sapiens
  misc_feature: GZ8MTXP01EAYU6.45.36.D03.1.454.CMB.2.raw
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
  modified_base (669)..(669): a, c, t, g, unknown or other
  misc_feature (669)..(669): n is a, c, g, or t
  modified_base (671)..(672): a, c, t, g, unknown or other
  misc_feature (671)..(672): n is a, c, g, or t
  modified_base (674)..(675): a, c, t, g, unknown or other
  misc_feature (674)..(675): n is a, c, g, or t
  modified_base (679)..(679): a, c, t, g, unknown or other
  misc_feature (679)..(679): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaaattgtgttgacacagtctccaggcaccctgtctctgtctccgagggganacagcccacctctcctgcgagggccaggtaggagtgtacaacgtaggttccgnggcaggtgggtctggggacagtagtcactctcgaccgtcaagcgagcccgtggacgtccgtgagttgttaatttttcggactttaaggttttacctttcgtcgttacagcgtaacgtccccggttacccggccgtaccgtcccgccgtttacccgtaaccgggtttcgggggacccggggggtaaccgtagggggtacggaagtacgtgggaaacggacgtaacgtggtcgggcctgaccgtactacgttcgtcgttacctccaacgtttccccgtttaccccggacgttaacgttcccgttaaggtaacccgttaggtaccgttcccggtccggtttaacgtcgggaaccggggttcccggggaccgttggggaacccgaaaggggttcccggaaacttaaggagtcgcgcgngnngnngcgngcgngng

SEQ ID NO: 345923 - DNA, 691 bp, Homo sapiens
  misc_feature: GZ8MTXP01A56NR.45.36.D03.1.454.CMB.2.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcagggccagtaggagtgtcagtaagtacttaggctaggtaccaanagaacctggccaggcctcccgaggcctcctcactccatgatgctatccgaacgtcgggtcccnggacctcccgagtaccgaggggttccgnggccccagggttcggtcgtagggggaactaagggtacgtttccacttcctaccgacccgggttcaacggccgtacgtcccgtggacgtacccgtggaacgttggttaacgttttcgtacttacggtttaacttcgttcgtaccgtacgtccgggtaacggttcccgtttcccgccccgtacgtccccgtccgtaccgttacccggtttcgggggaccgggggtaccgtgggggttacgaagggtagttcggaaacgggacgtaaacggtcggttaccgggttcgttccggtaacctaccgtaacgttcgttcgttaccgttccgttccgttcccg

SEQ ID NO: 345924 - DNA, 561 bp, Homo sapiens
  misc_feature: GZ8MTXP01C9082.45.36.D03.1.454.CMB.2.raw
  modified_base (187)..(187): a, c, t, g, unknown or other
  misc_feature (187)..(187): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (383)..(383): a, c, t, g, unknown or other
  misc_feature (383)..(383): n is a, c, g, or t
tcagacgcgatcgacacgaccggtgctcgatttagctgcgtcacgatctctcttgggtttggggggaagaggaagactgacggtcctcccaggagttcaggtgctgggcaccttggggcacgggggaggcgttgtccagcctgggaggtccctgagactctcctgtgcagcctctggattctccctnagttaactttggttccactgggtccgccaggttccaggcaaggggctggagtgggtgccctnattcgaagntggaagtgagagctactcagactcgtgaaggcgctcacatctcagagacaatcaagatgtctcttttgctaaatgaatagctgagacgtgagacacgtctagtctaattctgtgcgagggggacntctatgtagtcgtgtcgtagtagtaatctaactactactactacagtacggggtacgtcgtgggacgaaagggcctcggtacaccgtctccgctacggcttaacccgaacacgggcccttagtccgtccttccccgttgcccgtccctcgccgtccgacggacgtccaaccgtccggg

SEQ ID NO: 345925 - DNA, 579 bp, Homo sapiens
  misc_feature: GZ8MTXP01DTXOR.45.36.D03.1.454.CMB.2.raw
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
  modified_base (532)..(532): a, c, t, g, unknown or other
  misc_feature (532)..(532): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccacggaaaaattgtgttgacacagtctccaggcaccctgtctctgtctccgagggagacacgcccaccctctcctgcgacgggccaggtaggagtgtacagtaagtacttaggctaggtaaccaacacgaaaccgtcggaccgaacggctcccgaggcctcctcactccatgatcgacactaccgaaacgcgggtcctggcctccgagaccgtacggtcccgtggaccccgtagggtggtcgtggggacaagggacttcactcgtaccaccggtnagcagcgtgacncgtgatgtattcgntagttcnctagtcagtcagtccggtccnccgtacgccacgtcgtaacggttcggggacggggactagggtcggaagagttggaaccgngtaagtcggaggttcacgtcactgtactgttcttcgaactttccccg

SEQ ID NO: 345926 - DNA, 612 bp, Homo sapiens
  misc_feature: GZ8MTXP01E4NF0.45.36.D03.1.454.CMB.2.raw
  modified_base (211)..(211): a, c, t, g, unknown or other
  misc_feature (211)..(211): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (600)..(600): a, c, t, g, unknown or other
  misc_feature (600)..(600): n is a, c, g, or t
tcagacgcgatcgacacgaccggtgctcgatttagctgcgtcacgatctctcttgggtttggggggaagaggaagactgacggtcctcccaggagttcaggtgctgggcaccttgggcacgggggaggcgttgtccagcctgggaggtccctgagactctcctgtgcagcctctggattctccctcagtaactttggttccactgggtccnccaggttccaggcaaggggctggagtgggtgcctnattcgaagntggaagtgagaaggcctactcagactccgtgaaggccgcttcaccatctccagagacaatccaagaatgtccttctttttgactaaatcgaaatagcctgagtagttgaggacgacgtctagttctaatttctgtcggtaccgagggggtacatctagtgtaggttcgtagggttacggtagttagtaaatactaaacttaacttaacctaacctctagtcgggggtacgtcgtagggggacgaaagggtccgttcggtccaccgtctccgacacgtccttaaccgaaccgacgggtcccaacgtcccggttccttcccccgttggccctccgcgcctcaggacncgaaccgtcggg

SEQ ID NO: 345927 - DNA, 797 bp, Homo sapiens
  misc_feature: GZ8MTXP01BKZUN.45.36.D03.1.454.CMB.2.raw
  modified_base (205)..(205): a, c, t, g, unknown or other
  misc_feature (205)..(205): n is a, c, g, or t
  modified_base (373)..(373): a, c, t, g, unknown or other
  misc_feature (373)..(373): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagccacctctcctgcgagggccagtaggagtgtcagtaagtacttaggctaggtaccaacgacgaaaccgtggaccaggcctcccaggcctccgtcactccatgatcgacactaccgaacgtacgggtccctgggcccgtaccgaggtaccgtacgggttcccggnggtaccgtagggttcggggtccgtacggggaacctaacgggtacttttccgaaccgtttcccgtacccggtaaccccggttacgaacggtaccgaaccgggtccccgttaggggaaccgtcccgttaggttaacgttagggtttaaccttttttaggaccgtttaaacggttttttaccttcggtttacaacgttccgtacggggttcccggtttccccgaccgtaccccgggtcctcccgttaccggttaccggggtttaccggggggacccgggggtaacccgtaggggggttaaccgaacggtaaggttacgggaaaccgggaaccggttaagttccggggtaacggttaccgttcggaccctaaacccggtttacgtttccgttacgtttacccgttacccgtcccgtttccccgtcccg

SEQ ID NO: 345928 - DNA, 642 bp, Homo sapiens
  misc_feature: GZ8MTXP01D3AEY.45.36.D03.1.454.CMB.2.raw
  modified_base (293)..(293): a, c, t, g, unknown or other
  misc_feature (293)..(293): n is a, c, g, or t
  modified_base (361)..(361): a, c, t, g, unknown or other
  misc_feature (361)..(361): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctaggtaccaacagaaacctggccaggctcccaggcctccncatccatgatgcacgtcccaaacgtacggggttcccctgggccgtccccaggacctacgggttcccgnggccccgagggtcggggtcgtggggactaaggacgttcactcctcacccgtcagcagccctggacgtccgtgagtgttaatttcgtacttacggtttacttcttcgttacgacgtcgtacggttccggttccccgccgaccggtccccgtcgtccgttaaccggtttccgggggccgggggtacccggtaggggtcggaaggtagaggaacggttacggaaacgtgggttacggttcgttacggctaccgtcttcgtcgttccttaaccgttctttccccg

SEQ ID NO: 345929 - DNA, 764 bp, Homo sapiens
  misc_feature: GZ8MTXP01DJ37N.45.36.D03.1.454.CMB.2.raw
  modified_base (267)..(267): a, c, t, g, unknown or other
  misc_feature (267)..(267): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcgagggccagtaggagtgtacagtaagtacttaggctaggtaccaanacgaaacctggccaggcctcccgaggcctcctcactccatgatcgacactacccaacgtaccgggggtcccctgggacccgtacccgaggtaccgtacggggttcccgtgggacccgtaggggttcgggtccgtacgggggaacctaacgggtacgtttcccgaaccttcccgtacccgtaacccgtcgaagccgaacggtcccgtaggacgtacccgttagtagttagttaacgtttttcgaccgttttacggttttaaccttcgttacgttacgtaacggccgggtaacggttccccggtttaccccgacccggacccggtcccgttccgttaccggtttaaccccggggtttccggggggaccggggggtaacccggtagggggttaaccgggaaaaggttcggaaacggaacggttaaccggtagggttcgggttaccgttcggacctaacgtactccgttcggttccgttactaacccgtttcccttccccg

SEQ ID NO: 345930 - DNA, 664 bp, Homo sapiens
  misc_feature: GZ8MTXP01AGP5I.45.36.D03.1.454.CMB.2.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (572)..(572): a, c, t, g, unknown or other
  misc_feature (572)..(572): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcgagggccagtaggagtgtcagtaagtacttaggctggtaccaagagaaacctggccaggctcccaggctcctnactccangatgacataccaacgcgggtcccctgggccgtccccaggtaccgtacgggttccgtgggacccgtagggtcggggtctagggggacctaaaggtacgttccacgtcctaccgtaccggtcacggctacggccgtagggacgccgtaggacttggttaattttcggacctttaggttttaccttctcgggttcacggtcggtacggtcccgttccgaccgtaccgcccgtccgtcgtacccgggttcgggggccgggggtaccgtagggggnggaagtacggttaggaacggttacggtacggtcgggttacggcgttcgtaacctacgttcgttcgttccgttaccttccgttcccgttcccg

SEQ ID NO: 345931 - DNA, 654 bp, Homo sapiens
  misc_feature: GZ8MTXP01DKQ7U.45.36.D03.1.454.CMB.2.raw
  modified_base (202)..(202): a, c, t, g, unknown or other
  misc_feature (202)..(202): n is a, c, g, or t
  modified_base (490)..(490): a, c, t, g, unknown or other
  misc_feature (490)..(490): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaccaacagaaacctggccaggcctacccgaggctcctcactccatgatgcactccaacgacgggtcccctgggccgtccccgaggacctacggggtttcccgtggcccgagggtggggtccgtgggggactaagggtagtttccgaaaccttccgtaccgaaccccgtcgaacgccacgcccgtggacgtccgtgagttgtacgttttgtacttaggtttacttcgtgtacngtacgtacggtccgtttcccgccgaccgtcccgtcttccgtaccggtttcgggggccgggggtaccgtagggggtcggaaggtagttggaaggttaccgtaaagtcggttcgggcgttcggccgtaacctcgttccgtggttccctttcgttaacctttccccg

SEQ ID NO: 345932 - DNA, 554 bp, Homo sapiens
  misc_feature: GZ8MTXP01AYBVV.45.36.D03.1.454.CMB.2.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
  modified_base (449)..(449): a, c, t, g, unknown or other
  misc_feature (449)..(449): n is a, c, g, or t
  modified_base (496)..(496): a, c, t, g, unknown or other
  misc_feature (496)..(496): n is a, c, g, or t
  modified_base (531)..(531): a, c, t, g, unknown or other
  misc_feature (531)..(531): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggganacagccaccctctcctgcagggccagtaggagtgtcagtaagtacttaggctggtaccaacagaaacctggccaggctcccaggctcctcatccatgatgcatccaaacncgggtcccctggccgtccagactaggttccgtggcccaggtgggtctgggggacaaggacgttcactctcaccgtnagcagcctggacgtctgatgtattttcgactagtttacttctgttcagcgacgtccgttccncgtaccgccgtctacgtcgtttcgggccgggggtacaggggtgaagngttggacgacgacgtggttcgcgttcggctacctnttcgtcgttcttcgttcgttccg

SEQ ID NO: 345933 - DNA, 712 bp, Homo sapiens
  misc_feature: GZ8MTXP01AET4I.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccacctctcctgcagggccagtaggagtgcagtaagtacttaggctggtaccaacaagaaacctggccaggcctccgaggcctccgcactccatgactgcacgtccaaacgtcgggtccctgggcccgtcccgagtaccgtacgggttcccgtggccgtagggtggggtctggggacctaagggtacgttccactccgtcaaccggtcaagcacggtccctaggaccgtccgtggtacttggttacgttttcgtacgtttaacggttttacttcgttcgtcgtggtaccgtcggttcccggttccccgtacccggtaacccgggtccccgtaccgtaccggtttcccgggggttaccggggggtcccggggggtaaacccggggtcgggggtaacgggaacgggtaaggttacgggtaaaccgggttaacgggtaacggtgggttcgggccgttacggaacccgtacgtcgttccgttcgttccgttaacccgttccgttccccg

SEQ ID NO: 345934 - DNA, 583 bp, Homo sapiens
  misc_feature: GZ8MTXP01ASML2.45.36.D03.1.454.CMB.2.raw
  modified_base (523)..(523): a, c, t, g, unknown or other
  misc_feature (523)..(523): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggggaggtgtgtcacaagatttgggctctgggcaccggtgggcagtggggggagcgttgtccagcctgggaggtccctgagactctcctgtgcagcctctggattcctccctcagttaaccttttggttcccacgttggggtcccgccgtaggttcccagggcgaagggggctgggagtggggtcggccctcatttccgaagatgggaaagtggagaaggcctactcagactccgtagaacgggccgcttcaccatctccagacgaccaattcaaagtaatcgtaccttctttttgactaaatgaatagcctgagagttgagacacgtctgtctattctgtgccgaggggacatcgtagtgtagtcgttggttcgtagtgtaatctaactactactctcngttggacgttgtcgggacaacgggccttcgtcaccgtctcgcacgtccttccgaacccgg

SEQ ID NO: 345935 - DNA, 669 bp, Homo sapiens
  misc_feature: GZ8MTXP01EHSOY.45.36.D03.1.454.CMB.2.raw
  modified_base (200)..(200): a, c, t, g, unknown or other
  misc_feature (200)..(200): n is a, c, g, or t
  modified_base (279)..(279): a, c, t, g, unknown or other
  misc_feature (279)..(279): n is a, c, g, or t
  modified_base (648)..(648): a, c, t, g, unknown or other
  misc_feature (648)..(648): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaccggaaaattgtgttgacacagtctccaggcaccctgtctctgtctccgagggganacacgcccaccctctcctgcgagggccaggtaggagtgtcagtaagtactaggctaggtaccaagagaactggcaggcnccgaggctctacactccatgatcgacactaccgaacgacggggttcccctcgggcctaccgagtaccgtcgggttccgtggccgtagggttcgggtcgtaggggacctaagggtacgttctacgttccgtaccgtaccgtcgaacgcgtacgtcccgtagggactcgtaggtacttggttaacgttttcgactttaacggttttactcgttgtaccgtacgtacggaaccggtttcccgttaaccccgccgtaacccgtcccgtaccttaccgggtaaccggggtttccggggggaccgggggtactagggggtgaacgtaggttcggaacgttacgtaggtggacggttcacgcctacgtcgttcgtnttactaacgttcgtttccccg

SEQ ID NO: 345936 - DNA, 734 bp, Homo sapiens
  misc_feature: GZ8MTXP01EUT1L.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctccagataccaccggaaaattgtgttgacacagtctccaggcaccctgtctctgtctccgagggganacacgcccacctctcctgcgagggccagtaggagtgtcagtaagtacttaggctaggtaccaagagaaaccgtggaccaggcctcccgaggtcctcctcactccatgatcgacactacccgaaacgtacggggttcccctgggacccttaccccgaggtaaccgtacggggtttcccggtgggtacccgtggggttacggggtcgtagggggaccctaaagggtccgtttcccgaacgtttccgtacccgtacccggtcgaacgggccaacgggtcccgttagggactcccgttgaacttggtttaattttcggactttagttttacctcgtagttcgagtcccgtacggtcccggttcccgcccgaccggtcccgtaccgttccggtaaccgggtttccggggggaccggggggtaaccgtagggggtcggaagggtcgttaggggaacgttaacccggtaaggttcgggcggggttccttacgggaaccttaccctgtttccgtacgtttcttccgttaactttcccccg

SEQ ID NO: 345937 - DNA, 728 bp, Homo sapiens
  misc_feature: GZ8MTXP01EBGU6.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctccagataccaccggaaaattgtgttgacacagtctccaggcaccctgtctctgtctccgagggganacagcccaccctctcctgcagggccagtaggagtgtacagtaagtacttaggctaggtaaccaacgaagaaaccgtggaccgaggcctcccgaggcctcctcatccatgatcgacactacccgaaacgtacgggtaccccgtcgggccgtacccgaggtaccgtagggttccggtaggccgtagggtggggtcgtaggggacgaacgtacgttccgtactcctaccgaccgtaccgagcgaacggtccgtaagggtaaacctggtattacggtttaatttttcggaccttttaaggttttacctcgtcgtacagtccgttaacgggggtcccgtttccccggactaccccggtcccgtacccgttaccggttaccgggtttacccggggggacccggggggtaaaccgtggggggttaggaacggtaacgttggggaaacggttaacccgggttaaggtcgggtcggggaccttcggacccctaacgttctcgttcggttcccttagtccctttcccgttccccgg

SEQ ID NO: 345938 - DNA, 820 bp, Homo sapiens
  misc_feature: GZ8MTXP01D0HZT.45.36.D03.1.454.CMB.2.raw
  modified_base (211)..(211): a, c, t, g, unknown or other
  misc_feature (211)..(211): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcagggccaggtaggagtgtcagtaagtcttaggctggtacanagaacnggccaggctccaggctccncanccatgatcgacaatcccgaacgtacggggttcccctagggccgtaccccaaggaccgtacggggtttcccccgtaggggccgtaggttcggggtccgtaacggggacctaagggtacgtttaccaaccgttccgtacccgtacccgggttacaaacggccgtaaccggcccggttacggggaaccggttcccgtacggtaaacggttcggttaggtttttcggaccttaacgggttttaactttaccgtttcggttaccggtacggtaccgttaaccgggtaccccggtttccccgggtacccccgtacccgggtaccccggttcccgtttaccccgggttacccgggggtttacccggggggaccccggggggttaacccgggtaaacggggggttacggggttaacgggtaacggttaacggggaaaccgggttaaccgggttaaccggttcgggttaccgggtcgtaccgggtaacccgtaacccgttcgttaccgtttccgttcccgtttaacccg

SEQ ID NO: 345939 - DNA, 586 bp, Homo sapiens
  misc_feature: GZ8MTXP01AYQ0Q.45.36.D03.1.454.CMB.2.raw
  modified_base (400)..(400): a, c, t, g, unknown or other
  misc_feature (400)..(400): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtactaggctggtacaacagaaacctggccaggctcccaggctcctcatccatgatgcatcccaagcgggtcccctggccgtccagaccgtacggttccgtggccccgtaggtcggggtcgtggggacaaggtacgtttcaacttcgtcgaccgtnacgcacgcctggacgccgtgattggtatttgacttagtttacttcgtcgtcacgcgtacgtccgttcccgccgtaccgcccgtcgtccgtaccggttcggggccgggggtaccgaggggtggaagtagttggacgaccgaagtggttacgcgttggaaccacctgtccgtgttccttcgcttcccg

SEQ ID NO: 345940 - DNA, 606 bp, Homo sapiens
  misc_feature: GZ8MTXP01AXR1O.45.36.D03.1.454.CMB.2.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccaggtaggagtgtcagtaagtacttaggctaggtacaacagaaacctggccaggctcccgaggctcctcatccatgatgcatacccgaacgtcgggtccctgggcccgtacccgagtaccgaggttccggtggcccgtaggtcggggtcgtggggacaagtagttccacgtcctcaccgtcagcagccctggacncgtgactgtactttgacttagtttactcgtgtacgagtcgtacgtccggttacccgccgtaccgcccgtctcggtacggttccgggggacgggggtaccagggggtcggaagtagttcgggaacgaccgtaagtgggttacgcgttacggcctaacgtcttcgttgttacctcaacgtttccccg

SEQ ID NO: 345941 - DNA, 621 bp, Homo sapiens
  misc_feature: GZ8MTXP01C91FY.45.36.D03.1.454.CMB.2.raw
  modified_base (202)..(202): a, c, t, g, unknown or other
  misc_feature (202)..(202): n is a, c, g, or t
  modified_base (548)..(548): a, c, t, g, unknown or other
  misc_feature (548)..(548): n is a, c, g, or t
  modified_base (558)..(558): a, c, t, g, unknown or other
  misc_feature (558)..(558): n is a, c, g, or t
  modified_base (603)..(603): a, c, t, g, unknown or other
  misc_feature (603)..(603): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctccagataccacggaaaaattgtgttgacacagtctccaggcaccctgtctctgtctccgagggganacagcccaccctctcctgcagggccaggtaggagtgtacagtaagtattaggctaggtaccaacgagaaacctggccaggcctcccgaggcctcctcatccatgatcgcactaccaacgacgggtccctcgggccacccgaagaccgtacggttccgtgggccgtacgggttggggtcgtacgggggacaaacggtacgttccaccgttccgtaccgacccggtcacggtacgacgccgtaggacgtccgtgaatttgtaattttcgacttaagtttctctggtacaggtctacggtcccgttccgccacgtccgtctaccggtacggttcgggggcggggtacgnggggtgaagnggttacggaagacgtaacgtggacggcttacggcaccttgtcgtnttaccttcgcccgttccg

SEQ ID NO: 345942 - DNA, 799 bp, Homo sapiens
  misc_feature: GZ8MTXP01ECNB3.45.36.D03.1.454.CMB.2.raw
  modified_base (201)..(201): a, c, t, g, unknown or other
  misc_feature (201)..(201): n is a, c, g, or t
  modified_base (595)..(595): a, c, t, g, unknown or other
  misc_feature (595)..(595): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaacggaaaaattgtgttgacacagtctccaggcaccctgtctctgtctccgagggganacagccacctctcctgcgagggccaggtaggagtgtacgaagttaagtacgttagggacttacgggtaaccaaacgaacggaaaaccgtggacccgaagggcctaccccgaggtcctaccctacactccatgaactcgacacttacccaagtaccgggtcccacgggtcctaccccgagtaccgtacgggtttccggacgggtacccgtaggggttcggggtcgtacgggggtaaaccgtaacgggttaaaccgtttcccgaaacctttcccgtacccgtaaacccgttcgaacgggtccgaaaccggtcccgttagggggaacctcccgttagggaactttacgtttaagtttttcggactttaaacggtttttacctccgttagttaaccgngtaacccgggttacgggttccccggtttaacccccgacccggtaccggtccccgttaccggttaccgggttaacccgggggttcccgggggaaccgggggtaccgtagggggtaggtaacgtggttacggaacggttacggtacgtcggttacggcttacgtaacctacgttcgttcgtacgttccgttaaccttcccgttccg

SEQ ID NO: 345943 - DNA, 729 bp, Homo sapiens
  misc_feature: GZ8MTXP01BPMV4.45.36.D03.1.454.CMB.2.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (420)..(420): a, c, t, g, unknown or other
  misc_feature (420)..(420): n is a, c, g, or t
  modified_base (645)..(645): a, c, t, g, unknown or other
  misc_feature (645)..(645): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcgacgggccagtaggagtgtcaagtagtactaggctaggtaccaacacgaaacgtggaccaggcctacccgaggcctcctacactcctattatcgacctatacccaacgtcgggggtcccctggcccgttcccaggtaccgtacggggttccgnggcgtacggggtcggggttcgtaggggactaggtaacgttaccnccgttcctaccgtacccgtcgacgtaccgacgtcccgtggggactccggttaggtaacttggttaacgtttttcggacccgttttaaggttttacccttcgttacggtacgtaacgtcccgtacgggggttccggtttaccccggccgtaccccggtccgtccgttaccggtaccggtttccgggggggacgggggtacccggtagggggtcgggaacggtaagngggaaccggtacggttacgtcgggtcggcgttcgacctaacccgttgttcctaggtttccttaccggtaactttccccgtcccg

SEQ ID NO: 345944 - DNA, 568 bp, Homo sapiens
  misc_feature: GZ8MTXP01AD6GT.45.36.D03.1.454.CMB.2.raw
  modified_base (203)..(203): a, c, t, g, unknown or other
  misc_feature (203)..(203): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
  modified_base (521)..(521): a, c, t, g, unknown or other
  misc_feature (521)..(521): n is a, c, g, or t
  modified_base (553)..(553): a, c, t, g, unknown or other
  misc_feature (553)..(553): n is a, c, g, or t
  modified_base (555)..(556): a, c, t, g, unknown or other
  misc_feature (555)..(556): n is a, c, g, or t
  modified_base (558)..(568): a, c, t, g, unknown or other
  misc_feature (558)..(568): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgagggccaggtaggagtgtcaacgagggttccgngggcaggtgggtctgggacagagtcactctcaccgtnagcagcctggacnctgatggtatttggactagtttacttntgtcagctacgtccccgttccgccacggcccgcttacccgtacgggtttccgggggacggggggtacccgtagggggtcggagtgtaggaacggtacggtaacgttgggtaggtcgtcgacgtacccctagttccgtgttaccttctacttccttccccgctattcgtgactcgactcgcgttccggnggtcggcgggtcgtggaacgacggcgacgagngnngnnnnnnnnnnn

SEQ ID NO: 345945 - DNA, 668 bp, Homo sapiens
  misc_feature: GZ8MTXP01EQSY2.45.36.D03.1.454.CMB.2.raw
  modified_base (202)..(202): a, c, t, g, unknown or other
  misc_feature (202)..(202): n is a, c, g, or t
  modified_base (295)..(295): a, c, t, g, unknown or other
  misc_feature (295)..(295): n is a, c, g, or t
  modified_base (535)..(535): a, c, t, g, unknown or other
  misc_feature (535)..(535): n is a, c, g, or t
  modified_base (605)..(605): a, c, t, g, unknown or other
  misc_feature (605)..(605): n is a, c, g, or t
  modified_base (646)..(646): a, c, t, g, unknown or other
  misc_feature (646)..(646): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcagggccaggtaggagtgtcagtaagtacttaggctaggtaccaacagaaacctggccaggctcccgaggcctcncactccatgatgctactaccaaacgtaccgggtcccctcgggcccgttacccgaaggtaccgtacggggtttcccggtgggaccccgtaaggggttcggggttacggtacgggggtaaacccaagggttacggtttcccaaaccgtttcccgtaccgtaacccgttcgaacggccgaacgtcccgtagggactccgtagtacttaggttaattttcggactttagtttactcgtagtacncgtcgagttcccgtaccgccgacgcccgcttacggtccggttcgggggaccggggttacgaggggtcggngtagcgggaacgttccgtagtggttcggcttcgaacacgtntcgtgttcctcgaacttccccg

SEQ ID NO: 345946 - DNA, 731 bp, Homo sapiens
  misc_feature: GZ8MTXP01BZ8RR.45.36.D03.1.454.CMB.2.raw
  modified_base (202)..(202): a, c, t, g, unknown or other
  misc_feature (202)..(202): n is a, c, g, or t
  modified_base (402)..(402): a, c, t, g, unknown or other
  misc_feature (402)..(402): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtcctcgagggganacagcccacctctcctgcgagggccaggtaggagtgtactaaggtaagttagttagggactacgggtaaccaaacgagtaaacctggacccaaggcctacccgaggccttccgtactactccatgatcgccaactaccccaaacggtccgggttcccctacgggcccgtaccccgtaaggaccgttacggggtttccggngggtaccgtaggggttcggggtcgtaggggactaaaggtacgttttccgaactccgtaccgtaacccggtcgacgggccaaacggtcccgttagggaccgtccgtagtacgttcggttaagttttcgtacgtttacgttttaccttgtacgttacgaacgtcggtaacggttcccgttacccgccgtacccgtcccgtaccgttccgttaaccggggttccggggacggggggtacccgtagggggtcggaagtgggttaggacggttacgtaacggtgggttacgcgttcgcctacgtcgttcgtagttccttaacttccgttccccg

SEQ ID NO: 345947 - DNA, 614 bp, Homo sapiens
  misc_feature: GZ8MTXP01EK0J2.45.36.D03.1.454.CMB.2.raw
  modified_base (552)..(552): a, c, t, g, unknown or other
  misc_feature (552)..(552): n is a, c, g, or t
  modified_base (565)..(565): a, c, t, g, unknown or other
  misc_feature (565)..(565): n is a, c, g, or t
tcagacgcgatcgacacgaccggtgctcgatttagctgcgtcacgatctctcttgggttttgggggggaagaggaagactgacggtcctcccaggagttcaggtgctgggcaccttgggcacgggggaggtgtgtcacaagatttgggctctgggcaccgtgggcatgggggagcgttgtccagcctgggaggtccctgagactctcctgtgcagcctctggattctccctcagttaactttggttccacgtgggtccgcctaggttccagggcaaggggctggagtgggtggccctcattccgaagatggaagtgagaaggcctactcagactccgtagaacgggccgtcttcaccatcctaccagacgaaccctaacttaccaaagtaatcgttacccttactttttgactaaatagtaaatacgccgtagagtagttagacggtacacgttctgttacttattttcgtggttcgccggtaagggggtactagttacgttagtggtagttcgttggttcgtagtagttaactactaacttactactactntagttgacgttgngggacaacgggccttcggtctaccgtctccgcacgtccttccgaacccg

SEQ ID NO: 345948 - DNA, 708 bp, Homo sapiens
  misc_feature: GZ8MTXP01C2RSV.45.36.D03.1.454.CMB.2.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctctttaagaggtgtccagtgtcaggtgcgagggtggtgggaggtcggggggagcgttgtccagccgtggggaggtccctgacgtactctcctgtgcagcctctggatctccctcagttaactttggttccacgtgggtcccgccagggttccagggcgaagggggctgggaggtgggtcggccctcgactttccgaagacgttcggaagtggagaacggccctaactcaagacctccggtaggaacggggcccgacgtttccaccctacgtctaccgaagacgaactaaacgttaccaaaggtaacttcgttacccgttacttttttcggaacccttaaaagttacggtaaacgtacggttacccgtaaggtaaggttaaggttaggtacgggtaaaccgtaacgggttcttacgggttacctttagtttaaccgttggttcggacccggttaaagggggtaacctcgttacgttgttacggtaaggttaccgttggggtttacgttaggttacggtaaacgttccgttaaaaccg

SEQ ID NO: 345949 - DNA, 723 bp, Homo sapiens
  misc_feature: GZ8MTXP01EH5OS.45.36.D03.1.454.CMB.2.raw
  modified_base (216)..(216): a, c, t, g, unknown or other
  misc_feature (216)..(216): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccaccctcncctgcagggccagtaggagtgtcagtaagtacttaggctaggtaccaaacgagaaacctggccaggcctccccaggcctcctcatccatgatcgcaactcccaaacgtcgggggtcccctagggcccgtacccaggtaccgtacggggtttccccgaggggtcccctaaggggttcgggggtctaggggggtaaccctaagggttaacggtttccctaaaccgttccgtacccgtaacccccggttcaacggggcctaaacgggtccccgttaggggaacggtcccgttagggtaacttggtaacgtttttgggtcttaacggttttaccttcgtgttccgacggacggtcggtccgttcccgacccgtacgccccgtccgttaccgtccgggtttccgggggccggggggaccgtagggggtcgggaagttagttagggacgttacggtaaacgtggcggttcgttacggctacgtaacttcgtcgttccttcgttaacttccccg

SEQ ID NO: 345950 - DNA, 661 bp, Homo sapiens
  misc_feature: GZ8MTXP01ECI2W.45.36.D03.1.454.CMB.2.raw
  modified_base (201)..(201): a, c, t, g, unknown or other
  misc_feature (201)..(201): n is a, c, g, or t
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaccggaaaaattgtgttgacacagtctccaggcaccctgtctctgtctccgagggganacagcccaccctctcctgcgagggccaggtaggagtgtacaagttaagtattaggctaggtaaccaanagaaacctggccaggcctccgagcctcncatccatgatcgctactacccaaacgtcgggttccccncgggtcctacccgagaccgtacgggttcccgtggcctagggtgggtcgtaggggactaacgtacggttcaccttcgtccgacccgtcgagccgacgtcccgtaggacgtccgtagtacgttagttacgttttcgcgttaacggttttaccttacgttcgtacgtacgtccggtacggttcccgtttcccgcccgtaccggtcccgtcgttaccgtaccgggtttccggggaccgggggtaccggtaggggtcggaaggtgttaggacgttaccggaagttggttacggcttcgctacgtaacttcgtcgttcttccgttcttcccg

SEQ ID NO: 345951 - DNA, 744 bp, Homo sapiens
  misc_feature: GZ8MTXP01BKPQV.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaccggaaaaattgtgttgacacagtctccaggcaccctgtctctgtctccgagggganacacgcccacctctcctgcgacgggccaggtaggagtgtacaagttaagtacttaggctacggtacaacacgaaacctggaccaggcctccgaggcctcctcactccatcgatcgcactaccgaaacgtccgggggtccctggcccgtcccaggtaccgtacggggttccgtgggcccgagggttcgggggtcgtagggggactaacgggtacgttcgaccttcgtcccgaccggtcacggcacggtcccgtgggactccgtaggtaattggtttaacgttttgtactttacggttttaccttcgtagttaccgtacggtcggttacgggttccccgggttaccccgacccgttaccgggttccccgtccgtttaccgggttacccggggtttcccggggggggaccggggggtaaccgtggggggttaacggaaggtaagggttcgggaaacggttaacggtaacggttcggggttcggcgttacgaacccgtaaaccgttcgtttccgttcggtttactttaacccgttccgtttcccccg

SEQ ID NO: 345952 - DNA, 705 bp, Homo sapiens
  misc_feature: GZ8MTXP01BFUX7.45.36.D03.1.454.CMB.2.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggganacagcccaccctctcctgcgagggccaggtaggagtgtacaagtaagtacgttaggctaggtaaccaaacgagaaaccgtggaccagggcctacccgaggcctcctcactccatgatcgctactacccgaaacgacgggttccctcgggcccgtacccgaggtaccgtacggggttccggtggccgtagggtgggtcgtgggacaagtaacgttcactccaccgacgtcgacgcgtacgccgtggacgtccgtgaagttcgtttaagttttcggacttttaacggttttaccttgtcggtacacggcgtaacggttccggttccccgccgacgtccccgtcgttccgtaaccggggtttccggggacggggggtaccgtagggggtggaacggtacggttagggaaccggttaaaccggtaaggttcgggttcggggccttacgggaaccctaacccggtttcgtttccggttacgttccgttaaccgttcccgttaacccg

SEQ ID NO: 345953 - DNA, 726 bp, Homo sapiens
  misc_feature: GZ8MTXP01BI48D.45.36.D03.1.454.CMB.2.raw
  modified_base (264)..(264): a, c, t, g, unknown or other
  misc_feature (264)..(264): n is a, c, g, or t
  modified_base (353)..(353): a, c, t, g, unknown or other
  misc_feature (353)..(353): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggaccaanagaaacctggcaggctcccgaggcctcctcatccatgatcgcactcccaagcggggtcccctgggcccgtccaggaccacgggttccgnggaccagggtggggtctaggggacaagtacgtttcactcgtacaccgtcgagcgacgtcccgtgggacgtcccgtggattggttaagttttcggtacttacggtttttaaccttccgttacggtttctaacgggcctaacggtaccccggggttttccccgaccccgtaaccccggccccgtccgttcccgtaaacccgggtttttcccggggggacccgggggggggtacccggtacggggggttcggggaacgggaacgttaggggaaacccggttaaggggtaaacccggttgggttcgggccgttcgggaacccgaccgttaactttcccgttacgggtttaccctttccgttaacccttttcccccgg

SEQ ID NO: 345954 - DNA, 682 bp, Homo sapiens
  misc_feature: GZ8MTXP01AFKEU.45.36.D03.1.454.CMB.2.raw
  modified_base (202)..(202): a, c, t, g, unknown or other
  misc_feature (202)..(202): n is a, c, g, or t
  modified_base (353)..(353): a, c, t, g, unknown or other
  misc_feature (353)..(353): n is a, c, g, or t
  modified_base (517)..(517): a, c, t, g, unknown or other
  misc_feature (517)..(517): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaattgtgttgacacagtctccaggcaccctgtctctgtctccgaggganacacgcccaccctctcctgcgaggccaggtaggagtgtacgaaggttaagtacgttaggctaggtaaccaacgaggaaaccctggacccagggccctcccgacggtcctccgtcactccatcgatgcctactccgaacgtacgggtcccgnggacccgtcccgagtaccgagggttcccgaggccgtagggtggggtcgtaggggactagggtaaccttcaacgtcccgtacgacccgtcgaacgccgtaacgccgtaggaccgtcgtagtacgttagttagtttcgactttacgttttacctcgtgttaaccgnggacgtacggtccgttccccgaccgtacccgtccgtccgtaccgttcgggggttcccgggggacgggggtacgtacgggggtggaacgaggttacggacgttacggtacggtggttcggcttaccggtcgactcggtctcggtttacctcgttccgtttcccccg

SEQ ID NO: 345955 - DNA, 748 bp, Homo sapiens
  misc_feature: GZ8MTXP01CDN2H.45.36.D03.1.454.CMB.2.raw
  modified_base (202)..(202): a, c, t, g, unknown or other
  misc_feature (202)..(202): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcgagggccaggtaggagtgtcaagtaagtacttaggctaggtaccaacagaacctggccaggctaccgaggcctcctacgactcctatggatcgctacgtacccgaacggtccggggttcccctcgggcccgtcccgaaggtaccgtacggggtttcccgngggccccgttagggtcggggtcgtacggggaactaacggttaccgttcgaccgttcgtcccgaccgtcaaggccgacgtcccgtagggactccgtagtacgttgttacgttttcggtacttaacgtttcttcgttcggtactacggtacggtacggtcccggtttcccgacccgtacccggtcccgtcccgttaccgttaacccggggttccgggggtaccggggggtaacccgtagggggtgggtaacggtaggttacggggtaaacggttaccggtaaacggttcggggttcggttccggttacggtaacccgtaacgtccgtttccgttcggtttacctttccccgttaacgttttccccccgg

SEQ ID NO: 345956 - DNA, 749 bp, Homo sapiens
  misc_feature: GZ8MTXP01EGSTK.45.36.D03.1.454.CMB.2.raw
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
tcagacgcgatcgacacgaccggtgctcgatttagctgcgtcacgatctctcttggggaggaactgctcagttaggacccagagggaccatggaagccccagctcagcttctcttcctcctgctactctggctcccagataccacggaaaattgtgttgacacagtctccaggcaccctgtctctgtctccgaggggacacacgcccaccctctcctgcgagggccagtaggagtgtcaagtaagtactaggctagtacaacagaaacctggccaggctccgagctcctnatccatcgatcgcactaccgaacgtacgggggtcccctagggcccgtacccgaggtaccgtacggggtttccccggnggtaccggtacggggttagggtacgtacggggacctaaaggtaccgtttccaccgttacccgtacccgtaccggtacgacgggtacgacggtccggtaggacgtactagtagttacgtttacgttttacgtacgtttacgtttacgttcgttgtacgtacgtacgggttacggtcccggttaccccgacccggtcccggtcccgttccgttaccgggttacccgggggttaccgggggacccggggggtaccggtagggggtaaacgggtaaggtaacggttacgggtaaacgggttaaacgtacgggttcgggttacggttccgttacgtaaccgtaccgttaacgttcgttcgttaccttaaccgttcccggtttccccg

SEQ ID NO: 345957 - DNA, 703 bp, Homo sapiens
  misc_feature: GZ8MTXP01DMHIT.45.36.D03.1.454.CMB.2.raw
  modified_base (198)..(198): a, c, t, g, unknown or other
  misc_feature (198)..(198): n is a, c, g, or t
  modified_base (483)..(483): a, c, t, g, unknown or other
  misc_feature (483)..(483): n is a, c, g, or t
tcagacgcgatcgacacgaccggtgctcgatttagctgcgtcacgatctctcttgggggaggaactgctcagttaggacccagagggaaccatggaagcccagctcagcttctcttcctcctgctactctggctccagataccaacggaaaattgtgttgacacagtctccaggcacctgtctctgtctcgagggganacacgcccacctctcctgcgacgggccaggtaggagtgtacgaggttaagtacgttagggctagggtaaccaacgaacgaaaccgtcggaccacgggtccctacccgacggccttccctactactccgatgaatcgacaactaccgaaacggtccgggtccctacgggcccgtacccgaagtaccggtacggggttccggtagggcccgtaggggttcggggtccggaggggaaccctaaggtacgtttccaacgttcctaccgaccgtcaggtcagcctggacncgtgtagttgtattttggactttagttacttcgtgttcgagtcgtacggtccgttccaccgtacccgtccgtcgtaccggtacccgggtttcggggggaccgggggtaccgtagggggtcgaaggtacggacggaacggttaccggtaaacggttcggttcgggcttacgggaaccttaacctgtttccgtcggttactttaacccttccggtttccccg

SEQ ID NO: 345958 - DNA, 609 bp, Homo sapiens
  misc_feature: GZ8MTXP01D6PCG.45.36.D03.1.454.CMB.2.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (405)..(405): a, c, t, g, unknown or other
  misc_feature (405)..(405): n is a, c, g, or t
  modified_base (584)..(584): a, c, t, g, unknown or other
  misc_feature (584)..(584): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgaggggaacagccaccctctcctgcaggccagtaggngtgtcagtaagtacttaggctaggtaccaanaagaaaccgnggcaggctcccgaggcctccnatccatgatgcaatccaagcgggtcctggcgtcccagacgtaggtcccgnggntaggtggtcgtagggactgagttacacgtcctacgacgtcagcagtccgnggacgtcctgtactgttactttaggacttaggtttacttcgttgttacgtacgtacgtacggtccggtttcccgaccgtaaccggtcccgtcgttacccgtaacgggtttccggggaccggggggtacccgaaggggttcggaggtacgttggacggacgttaaagttggttacggtcncgaactactcgttctcgttctaacg

SEQ ID NO: 345959 - DNA, 624 bp, Homo sapiens
  misc_feature: GZ8MTXP01DARIP.45.36.D03.1.454.CMB.2.raw
  modified_base (286)..(286): a, c, t, g, unknown or other
  misc_feature (286)..(286): n is a, c, g, or t
  modified_base (588)..(588): a, c, t, g, unknown or other
  misc_feature (588)..(588): n is a, c, g, or t
  modified_base (614)..(614): a, c, t, g, unknown or other
  misc_feature (614)..(614): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccacggaaaattgtgttgacacagtctccaggcaccctgtctctgtcctccgaggggagacacgccaccctctcctgcgacgggccaggtaggagtgtcagtaagtacttaggctaggtacaacagaactgcagctccagctcncactcatgatcgcactaccaacgtaccgggtccgtcggccgtaccgagtaccgtacggttcggcggccgtagggtcgggtcgtggaccgtaagtacgttcactctaccgacgtcacgcacgtccgtaggacctcgtgtactagttactttgacttaagtttctcgtagtacgacgtcggtaaccggtccgttcccgaccctaccggtcccgtcgttacggttaccccgggggtttcggggggaccgggggtacgtaagggggtcgaaggtacgttacggacggacgtacgtgggttacggcngtaacccacttgttcgattcctaacncgtttccccg

SEQ ID NO: 345960 - DNA, 840 bp, Homo sapiens
  misc_feature: GZ8MTXP01AM1GF.45.36.D03.1.454.CMB.2.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggggaggtgtgtcacaagatttgggctctgggcaccgtgggcatggggagcgttgtccagcctgggaggtccctgagactctcctgtgcagcctctggattcctccctanagttaactttggttccacgtgggtcccnctaggttccagggcaaggggctgggagtgggtcggccctctacgttccggaaagagtagggaaaggtggaaaggaacggtcccctactcgaaggaccgttccggtaggaacggggtcccgtactttaccaaccgtacttcctaccgaaggtaacgaacccctaaactttaccgaaaagtaacttcggttaacccctttcgtttttaaggacctaaaagttacggaaacttacggtcccgtaaggtaaggtacggtttaggaacgggtaacctaacgggttccttaggtttacgtttaacgttttacccgtggttacggaccccgggtaaggggggtaacctaacgttaccgggttaagttagggttaacggttccggtttagggtttaccggttaggttacgttaaacgttaacctaaacctttaaccgttaacccgttaaccctaacgtaagttacgggtaacccggttacgggttacgggggaaccgttaaaaccgggggttcccgttaccggggtaacccctaccggttccccgttacccggacgttaaccgtcccgtttaacccgaaaccccggg

SEQ ID NO: 345961 - DNA, 768 bp, Homo sapiens
  misc_feature: GZ8MTXP01DVW41.45.36.D03.1.454.CMB.2.raw
  modified_base (210)..(210): a, c, t, g, unknown or other
  misc_feature (210)..(210): n is a, c, g, or t
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttggggggccctggggaggaactgctcagttaggacccagagggaaccatggaagccccagctcagcttctcttcctcctgctactctggctccagataccaccggaaaattgtgttgacacagtctccaggcaccctgtctctgtctccgagggganacacgccacctctctgcgaggcagtaggagtgtcagtaagtacttaggctacggtacaacaagaaccgtggccaggcctacccgaggtcctcctnacgtccatgatcgactactaccgaacgtaccggggtcccctgggtacccgttaccccgaaggtaccgtacgggtttcccccggngggtacgtagggttcggggtcgtaacggggaactaacggtacgtttcccaccgtttacctccgaccggtcgaacgtctacgggtcccgtagggacgtccgttaaggtaacttggttaattttcgggactttaacggtttcctttacgttcgggtaacctacggttaccgtaccggttccccggttcccgaaccccgtaccggtaccccgggttacccgtttccggttaacccggggggttttcccggggggaaccggggggtacccggtaacgggggtttaggggaagttaaccggagggtaaacccggtaacgggttacggttcgggttcgtaacggtccgtaaccgaaccgttcgttcctttcggttaaccttcccg

SEQ ID NO: 345962 - DNA, 582 bp, Homo sapiens
  misc_feature: GZ8MTXP01DVH5R.45.36.D03.1.454.CMB.2.raw
  modified_base (201)..(201): a, c, t, g, unknown or other
  misc_feature (201)..(201): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
  modified_base (569)..(570): a, c, t, g, unknown or other
  misc_feature (569)..(570): n is a, c, g, or t
  modified_base (572)..(582): a, c, t, g, unknown or other
  misc_feature (572)..(582): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccaggcaccctgtctctgtctccgagggganaccagccaccctctcctgcagggccagtaggagtgtacaacgtaggttccgnggctaggtggtctgggacagtacgtcactctcacgtcagcagcctaggacgctagntagtatttgactagttttacttcgtagttccagctacggtccccgttcccgacctacgcccgcttacccgtacggtttccgggggacgggggtaacccaggggttcgaggacgtgggaagtaccggaagttcggtgggaccttggactacgtattctggtccttcactttccgttccccgcgtaacttccgtagttactacggtcttcggccgttacgtgtacgggccgggcgtggggaaccaggggccaggttataggnngnnnnnnnnnnn

SEQ ID NO: 345963 - DNA, 731 bp, Homo sapiens
  misc_feature: GZ8MTXP01DOCNV.45.36.D03.1.454.CMB.2.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (693)..(693): a, c, t, g, unknown or other
  misc_feature (693)..(693): n is a, c, g, or t
tcagacgcgatcgacacgaccggtgctcgatttagctgcgtcacgatctctcttggggaggaactgctcagttaggaccaagagggaaccatggaagccccagctcagcttctcttcctcctgctactctggctcccagataccacggaaaattgtgttgacacagtctccaggcaccctgtctctgtctccgagggganacacgccaccctctcctgcgagggccaggtaggagtgtacagttaagtacttaggctagtaccaanagaactgacagcnccagctcncatcatgactgactactaccaacgtaccgggtcctcgggcccgtacccaggtaccggtacggggtttccccgaggggtccccgtacggggttcgggggtacgtagggggtaaacctagggtaactttcccgacttccgtacccacggtcgacgtcgacgccgtaggactcgtagtacttgttaacttttcggctttacgtttactcgttgtactacggtacggtaccggttccgtttaccccgcccggtaaccgtccccggtcctttacccgggttaccggggttttaccggggggacccgggggggaacccgtggggggttaacgaaaggttggttacggggaaacggttaaccggtaaccgggttggttaccgggttcggttacccaacctaccgtccggtttntcccgggtttacctttaacggttccctttaacccccgg

SEQ ID NO: 345964 - DNA, 702 bp, Homo sapiens
  misc_feature: GZ8MTXP01EL9HW.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagcccaccctctcctgcgagggccagtaggagtgtcagtaagtactaggctaggtacaanagaaacctggaccaggctacccgaggcctcctcatccatgatgcataccgaacgacgggtcccctgggaccgtaccccaggtaccgtacggggtttcccggacgggtaccccgtaggggttcggggtacgtagggggaacctaaacgggtaacgtttccgaaccgtttccgttacccgaacccggttccgaacggtccgaacggtcccgttagggggactcccgttaggaacttggttaagtttttcggacttaggttttaccttcgtcgttacgacggtcgtaacggtcccgtttaccgcccgtacggcccgtcgttacggtaccgggttccgggggaccgggggtacgtagggggtcgaagtagttacggaacgacggtacgtgggttaacgcttcggaacctacgtcttcgtcttccttaaccttccgttccccg

SEQ ID NO: 345965 - DNA, 614 bp, Homo sapiens
  misc_feature: GZ8MTXP01ELOSF.45.36.D03.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtactaggctggtaccaanagaaacctgccaggctccgagctcctcatccatgatgcatcccaagcggtccctggcctccagacacggttccgnggccaggtggtctgggacaagagtcactcncacgtnaggcagcctggancctgatgtacttttgctagtttactcgtagtcagcgaacgtccgttccgacccgaccggtccccgacgttcgtacccggggtttcggggacccggggggtacccgtacgggggttagggaaggtaacggttagggaaacggttacccggtaaacgttggggttcgggcgttacggtcccaaccggtaacttccgtaccggtttcttaacccgttaaccttttcccccgg

SEQ ID NO: 345966 - DNA, 681 bp, Homo sapiens
  misc_feature: GZ8MTXP01BL11P.45.36.D03.1.454.CMB.2.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (650)..(650): a, c, t, g, unknown or other
  misc_feature (650)..(650): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaaccggaaaaattgtgttgacacagtctccaggcaccctgtctctgtctccgagggganacacgcccaccctctcctgcgagggccagtaggagtgtcagtaagtataggctaggtaccaacagaaacctggaccaggcctccgaggcctccgtcactccatgatcgcatacccaaacgcggggtcccctgggccctcccgagtaccgtaggttccgnggccgagggtgggtctggggacacgtagttcacgtcncaccgtnacgcacgccgtaggacgtcctaggtatagtttagttttacgctttaaacggtttaccttcgttcgtacgtaacgtccgggtaacgttcccggttacccgccccgtaaccgtccccgtcgttcccgttaaacccggggtttcgggggacccggggggtaacccgtagggggttcgggaacggtacggttaggaaccggttacgggtaaacggttgttacggggctttccgaacgtaaccccgttnttccgttcgttccttccgttaaccgttcccg

SEQ ID NO: 345967 - DNA, 720 bp, Homo sapiens
  misc_feature: GZ8MTXP01BJNSJ.45.36.D03.1.454.CMB.2.raw
  modified_base (324)..(324): a, c, t, g, unknown or other
  misc_feature (324)..(324): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaattgtgttgacacagtctccaggcaccctgtctctgtcctccgaggggagacagcccaccctctcctgcgagggccaggtaggagtgtcagtaagtacttaggctcggtacaacagaactgcaggctccaggctcctcatccatgatgtcactaccaacgacgggtcccngggcctcccgagaccgtcgggttccgtgggcccgtagggttggggtcgtcgggggactaacgggtacggtttccacgttccgctacccggttcacgggactacgggtccccgtaagggccgtcccgtaggtaccgttggtttaaacgtttttcggaactttaccgggtttttaacttccgttagggttaccaacggttccggtaacggggttccccgtttccccggaccggtacccgtcccggtcctttacgggtaccccgggtttacggggggacccggggggttacctaggggggtcgggaacgtaaggttccgggtaaaggacggtaaacggttcgggcgggccaggtaacccgtaccgttcgttcggtacgttcccttccgttccgttcccg

SEQ ID NO: 345968 - DNA, 818 bp, Homo sapiens
  misc_feature: GZ8MTXP01APYFJ.45.36.D03.1.454.CMB.2.raw
  modified_base (202)..(202): a, c, t, g, unknown or other
  misc_feature (202)..(202): n is a, c, g, or t
  modified_base (776)..(776): a, c, t, g, unknown or other
  misc_feature (776)..(776): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgcccaccctctccgtgcgacgggccaggtagggagtgtacgtaaggttaacgttacgttagggacttacgggtaacccaaacgtacggaaaacccgtggacccgaacggccctacccgagggcccttaccctcgaacctcccgtaatacggagttacgaccgtaacctaaccccgaaaacggtaccggggttcccccgtacggggtaccccgttacccccggaacggtaaccggtaccggggtttccgggtcggggaccccgtaaggggttcgggggtcgttacgggggaaccgtaaaacgggttacggttccaccgttacccgtacccgtacccgggttacaacggcgttaaccgcccggttggggaaccgtaccgtacgtagttaggttttacgtttacggtactttaacggtttcttcgtacgtacgacggtccgtacggtccgttacccgccgtaccgtcccgtgtacccgtcggggtttcggggcccgggggttaccgtagggggtaccggtaagtggttacgggaacggttacggtaaaccgttggggttacgttccgttaccncggtctaacgttgtacgttccttaacgttaaccctttcccgg

SEQ ID NO: 345969 - DNA, 710 bp, Homo sapiens
  misc_feature: GZ8MTXP01BDBH9.45.36.D03.1.454.CMB.2.raw
  modified_base (203)..(203): a, c, t, g, unknown or other
  misc_feature (203)..(203): n is a, c, g, or t
  modified_base (677)..(677): a, c, t, g, unknown or other
  misc_feature (677)..(677): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgacgggccaggtaggagtgtactagtaagtacttaggctacggtaaccaacgaagaaaccgtcggacccaggcctcccgaggtcctcctacactcctaagtgtaactcgacctaacgtaccccgaaacgtaccgggggtcccctacgggcccgttacccgacgtaccgtacggttcccgggtgggtaccccgtagggggttcggggtcgtcgggggaacctaagggtacgttcgaacccgttccgtccgaaccccggtgacgggcgtaacggtcccgttaggggaccgtaccgtggtactttgggttaacttttttcgctttaaacggttttcttcgttcgtacgagtccggtacgttcccggttaccccgccgacccgtccgtcccttcggtaccgggttccgggggaccggggagtcgggggtgaacgaggttggaaagttccgaagttcggnggcttcgcactgtctcgttacttcgttctcccg

SEQ ID NO: 345970 - DNA, 621 bp, Homo sapiens
  misc_feature: GZ8MTXP01AEJZO.45.36.D03.1.454.CMB.2.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
tcagacgcgatcgacacgaccggtgctcgatttagctgcgtcacgatctctcttgggttttggggggaagaggaagactgacggtcctcccaggagttcaggtgctgggcaccttggggcacggggggaggcgttgtccagcctgggaggtccctgagactctcctgtgcagcctctggattctccctnagtaactttggttccagtgggtccnccaggttccaggcaaggggctgggagtgggtgccctnattccgaagntggaagtgagagctatcagactcgtgaacggcgcttcacatcncagagacaatcaagaatgtccttnttttanctaaatgaaatgctagagtacgttgaggactacgtctagttcttaattctgtgccgtaggggctatctatgagtcgtggttacgtagtagtatactaactactactactntatggggtacgtcgngggacgaaaccggtccgtacgtaccgtaccgtcgtccgacgtaacgccctttcccaaccggttacgggccccgttaacgtcccggtttccccgttccccggttggccccgtccccgtcggtcccgttccgaacgggttaccgccgttccccggttccggggg

SEQ ID NO: 345971 - DNA, 724 bp, Homo sapiens
  misc_feature: GZ8MTXP01B00CN.45.36.D03.1.454.CMB.2.raw
  modified_base (200)..(200): a, c, t, g, unknown or other
  misc_feature (200)..(200): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccacctctcctgcagggccagtaggagtgtcagtaagtacttaggctaggtaccaacagaaacctggccaaggcctcccgaggtcctcctcatccatcgatcgactactcccaaacgtacgggtcccctgggtccctacccagaccgtacggggttcccgtagggtaccccgaggggttacggggtccgttagggggacctaaacgggtaacgtttccgaaacccgtccgtttacccgaaccccggtttcaacgggcccgtaaacgggtccccgttaggggaaccgtcccgttaggtaacttggttaagtttttcggactttacggttttactcgttagttacacggtcgtacgtcccgtttcccgaccgtaccgcccgtcgtaccggtacggtttccgggggacgggggtaccctagggggtgaacggtacgttgggaacgttaaccggtaacgttcggttcggcgttaccggaaccgtaccctaacgttcggtcttaccgtttccgaacctttcccgg

SEQ ID NO: 345972 - DNA, 671 bp, Homo sapiens
  misc_feature: GZ8MTXP01BJ0MT.45.36.D03.1.454.CMB.2.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (428)..(428): a, c, t, g, unknown or other
  misc_feature (428)..(428): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctccagataccacggaaaattgtgttgacacagtctccaggcaccctgtctctgtctccgaggganacagcccacctctcctgcgagggccaggtaggagtgtacgagtaagtactaggtctaggtaacaacacgaaactcggccaggcctccgaggtcctccnactccagtgactnacactcccgaaacgtccggggtccctcgggaccgttcccgagaccgtacggggttcccgtgggtacccaggggttgggtcctaggggactaacggatttccgactcttcgaccggtnacgtcacgcccgtgcgtctaggacttgttagtttcgctttaacgttccttgtcttcgacgtacggcggttcccgttaccggaccctccggtccgtcctccggtacggtttaccgggggccggggggtacttaacgggggtgggaacgtaacggttcgggtaacggttaaccggtaggtcgggttcggacgttcgaaccggtaacctcgtcggttccgttaacctcggtttaaccgttcccccg

SEQ ID NO: 345973 - DNA, 785 bp, Homo sapiens
  misc_feature: GZ8MTXP01BPLI7.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgcccaccctctcctgcgagggccaggtaggagtgtacaaggtaagtactagggctaggtaccaacgtacgaaacctggaccacggcctcccgaggtcctcctcactccatcgatcgacactacccgaaacgtcgggttccccgtacgggtcccgtaccccaaggtaccgtacgggttcccggtacgggaccgtacggggttcggggaccgttaggggaacctaaagggtaccgttcacctcgtacccgtaacccgtcaacggccgtaaaccggtcccgtaggaaccgtccgtacggtagttagttaacgtttttcgaaccgtttagttttaccgttcttcggttactacgggtaccttaacgttccccggttccccgacccggttaccgccccgttcccgttaccggtaaccggggttttccggggggaccggggggtacccgtaaggggggttccgaaacggggtttaggacggggaaaccgttaccgggtaaacggtttcggggacggttcccgttaccggaaccgtaaccctcggtttcccgtacggtttccgtttaacccgttccttttcccccgg

SEQ ID NO: 345974 - DNA, 644 bp, Homo sapiens
  misc_feature: GZ8MTXP01D4MB1.45.36.D03.1.454.CMB.2.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (397)..(397): a, c, t, g, unknown or other
  misc_feature (397)..(397): n is a, c, g, or t
  modified_base (617)..(617): a, c, t, g, unknown or other
  misc_feature (617)..(617): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccacggaaaaattgtgttgacacagtctccaggcaccctgtctctgtctccgagggganacagccaccctctcctgcgacggcaggtaggngtgtanaagtagtactaggctaggaacaacagaacctgcagctccngctcnactcangcacacnccgaagtacggtccctggccctaccaggtacgtacgggttccgnggcgtaggttcggggtctacggggactaggaacgttcaacgtcacggacccttnaacgtcacgggtcctaggatccgaggtatcggtttaagttttcgtacgttacgttttacgtcgttcgtacgtaacgtccgttaacggggttcccggttcccgacccgaccggtcccgtccgtccgggttaacggtttcccgggggaccgggggtacgtacggggtcggaagtaaggttgaaacgggtacgaccgttggtcggaccgttgctaacccgttntcttcgtcttaccgttccttccggtcc

SEQ ID NO: 345975 - DNA, 696 bp, Homo sapiens
  misc_feature: GZ8MTXP01A5BIG.45.36.D03.1.454.CMB.2.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaaattgtgttgacacagtctccaggcaccctgtctctgtctccgagggganacacgccacctcncctgcaggccagtaggntgtcaagtatacgtagctagtacaanagaactgcagctccngctcnactcntcatgctactaccacgtacgggtcccnggcccgtaccaggtaccgagggttccgcggtacgagggttcgggtacgtacgggacaaacggtactttccgacctttaccgccgtacccgggtcacgtccgtagccgtaggtacgtaccgtggtatcgttaagttttcgacggtttacgttttaacttcgtaacggttctaaaccggtcgttaacggttccccggttccccgttacccgaacccgttccccgtaccgtttacccggtaaacccgggggttttcgggggaaccccgggggtaccgggtaagggggttccgtaagggacgggttaggaaacgttacgggtaaccgtgggttacgggcttaccgtcgaacccggtttcgttccgttcgtttacctccgttccgttcccg

SEQ ID NO: 345976 - DNA, 522 bp, Homo sapiens
  misc_feature: GZ8MTXP02GD0C6.45.36.D03.1.454.CMB.2.raw
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctnatccatgatgcatccaacngggtccctggcctccagacaggttccccgnggcaggtgggtctggggacngagttcactctcaccgtnagcagcctggagcctgatgtattttgctagtttacttctgtcagtcagcgttccgccacgccgctcacgtttcgggcgggggtaccaggggtggagacgtggagacgaacgtggtggcgtgcacatctcgtcttc

SEQ ID NO: 345977 - DNA, 533 bp, Homo sapiens
  misc_feature: GZ8MTXP02F9B1Z.45.36.D03.1.454.CMB.2.raw
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (383)..(383): a, c, t, g, unknown or other
  misc_feature (383)..(383): n is a, c, g, or t
  modified_base (468)..(468): a, c, t, g, unknown or other
  misc_feature (468)..(468): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaangggtccctgggcctcccagaccagggttccgtggcccaggtgggtctggggacaggagttccactctcaccgtnagcagcctggacgctgatgtatttgctagtttactctgttcagcagtcgttccgccacgccgctcacgtttcgggcgggggaccnggggtcggagagtggacgtacggaacgtggtcggctggccgaccatcctggttctcactttcccg

SEQ ID NO: 345978 - DNA, 521 bp, Homo sapiens
  misc_feature: GZ8MTXP02GO1BM.45.36.D03.1.454.CMB.2.raw
  modified_base (202)..(202): a, c, t, g, unknown or other
  misc_feature (202)..(202): n is a, c, g, or t
  modified_base (387)..(387): a, c, t, g, unknown or other
  misc_feature (387)..(387): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacagggtccctgggctcccagacaggtccgtggcccagtgggtctggggacagagttcactctcacgtcagcagctganctgatgtatttgctagtttactctgtcagcagcgttccgccacgcccgctcgacgtttcgggcgggggtaccaggggtcggaggagtggacggacgaacgtgtcggctggcaccgatctgtcttctacttcccg

SEQ ID NO: 345979 - DNA, 544 bp, Homo sapiens
  misc_feature: GZ8MTXP02FNTZM.45.36.D03.1.454.CMB.2.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtacttaggctggtaccaacagaaacctggccaggcctcccaggcctccncatccatgatgcatccaacgnggggtcccctgggcctcccagaccagggttcccgtggcccaggtcgggtctggggacaggagttcactctcaccgtnagcagcctggagcctgatgtatttgctagtttactctgtcagcacgtccgttcccgccgacgcccgctccgtacgtttcggggccgggggtaccgngggggtcggaggngtggacgacgacgtggtcgctgcgacatctgtctacgcttccg

SEQ ID NO: 345980 - DNA, 535 bp, Homo sapiens
  misc_feature: GZ8MTXP02JBL9Y.45.36.D03.1.454.CMB.2.raw
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (426)..(426): a, c, t, g, unknown or other
  misc_feature (426)..(426): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaacctggccaggctcccaggctcctcatccatgatgcatccaacngggtcccnggcctccagacnggttccccgngctaggtgggtctggggacnggtagttcactctcaccgtnagcagcctgagcctgatgatttgctagtttactcggtntcagtcagtcgttccgccgtacgccgctccgtcgtttcgggcgggggtaccgaggggtcggaggacgtaggagtacgaacgtggtggcgtcgcaccgatctgtcttacg

SEQ ID NO: 345981 - DNA, 523 bp, Homo sapiens
  misc_feature: GZ8MTXP02IP4YP.45.36.D03.1.454.CMB.2.raw
  modified_base (262)..(262): a, c, t, g, unknown or other
  misc_feature (262)..(262): n is a, c, g, or t
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagcccaccctctcctgcagggccagtaggagtgtcagtaagtacttaggctggtaccaanagaaacctggccaggctcccaggctctcatccatgatgcatccaaacagggtcccctgggccgtcccagaccaggttccgnggccaggtgggtctgggacagagttcactctcaccgtnagcagcctgagcctgatgtatttgctagtttacttctgtcagcagtcgttcccgccacgccgctctacgtttcgggcgggggaccgaggggtggaggagtggagaacgaacgtgtcggctgcacatctgtcttcacttcccg

SEQ ID NO: 345982 - DNA, 531 bp, Homo sapiens
  misc_feature: GZ8MTXP02G3FT3.45.36.D03.1.454.CMB.2.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaanggggtcccctgggcctcccagacaggttccgnggcccaggtgggtctggggacaggagttcactctcaccgtnagcagcctggagcctgatgtatttgctagtttacttctgtcagcagtcgttccgcctacgccgctcgacgtttcgggcgggggtaccaggggtcggagagtggacgacgacgtggtcggctggctaccagttctgtcctttcactttccc

SEQ ID NO: 345983 - DNA, 570 bp, Homo sapiens
  misc_feature: GZ8MTXP02GXP54.45.36.D03.1.454.CMB.2.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (386)..(386): a, c, t, g, unknown or other
  misc_feature (386)..(386): n is a, c, g, or t
  modified_base (512)..(512): a, c, t, g, unknown or other
  misc_feature (512)..(512): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcaagtaagtacttaggctggtaccaacagaaacctggccaggcctcccaggctcctcatccatgatgcatcccaagngggtcccctgggcctcccagacgaggttccgnggccaggtgggtctggggacaggagttcactctccaccgtnagcacgcctggacgcctgatgtattttcggactagtttactctgtcagctacggtccgttcccgccaccgtcccgcttccgtacggtttcgggaccggggggtaccgagggggttcggaaggtagngggaacgtaccgaaggtcgtggctggaaccacgtacgttctcgtccttcactttcccg

SEQ ID NO: 345984 - DNA, 563 bp, Homo sapiens
  misc_feature: GZ8MTXP02JZVW8.45.36.D03.1.454.CMB.2.raw
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacgngggtcccctgggccgtcccagaccaggttcccgtggcccaggtggggtctggggacagtagttcactctcaccgtcagcagcctggagcctgatgtatttgctagtttacttctgtcagtcagtcgttccgccgaccgccgctcgtacgtttcgggccgggggtaccgaggggtggacggagtggacgaacggaacgtcggtcggtcgtcggccgaaccgtagtccgttcgttcctttactactttccccg

SEQ ID NO: 345985 - DNA, 603 bp, Homo sapiens
  misc_feature: GZ8MTXP02F9R0P.45.36.D03.1.454.CMB.2.raw
  modified_base (265)..(265): a, c, t, g, unknown or other
  misc_feature (265)..(265): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtcctccgaggggagacagcccaccctctcctgcagggccagtaggactgtcagtaagtacttaggctggaccaanagaaacctggccaggctcccaggctcctcatccatgatgcatccaacngggtcccctgggccgtcccagaccaggttccgnggcctaggtcgggtcgtggggacaggtacgttccactctccgaccgtgacgcacgccgtggacgccgtgattgtagtttcgtacgttagtttacttcgtgtcagtcgtacgtccgttcccgccgaccgcccgtcctcgtaccggttcggggccgggggtaccgtaggggtcggacggtaggtaggaacggtacggtaacgtcgggtacggtcgtacgaaccgtaccgtacgttcgttcgttccttactactttcccg

SEQ ID NO: 345986 - DNA, 557 bp, Homo sapiens
  misc_feature: GZ8MTXP02FM9QD.45.36.D03.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggctcccaggcctcctcatccatgatgcatccaanacgggtccctgggccgtcccagaccagggttcccgtggcctaggtgggtctaggggacagtagttcactctcaccgtnagcagcctganctgatgtatttgctagtttacttntgttcagtcagccgttcccgccaccgcccgctccgtacgtttcggggccgggggacccgtaggggtcgggagtagtaggacggaacgaacgtggtcggctggaaccaccgattcgtcgtcttccactttccccg

SEQ ID NO: 345987 - DNA, 580 bp, Homo sapiens
  misc_feature: GZ8MTXP02GEN50.45.36.D03.1.454.CMB.2.raw
  modified_base (261)..(261): a, c, t, g, unknown or other
  misc_feature (261)..(261): n is a, c, g, or t
  modified_base (417)..(417): a, c, t, g, unknown or other
  misc_feature (417)..(417): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggaccaanagaaacctggccaggcctcccgaggctcctcatccatgatgcatcccaacgacggggtcccctgggcctaccccgagaccgtagggtttccccgtgggcccctagggttcggggtcctgggggaacctaggagtttccacgtcctaccgacccgtnaacgccagccgtggacgctggattgtatttgctagtttctctgtcagcagtccgttccgcctacgcccgctcgtacgttcggggcggggaccgngggtggacgngtaggacggacgtaacgtggtacggctcggaacacctagtctggttctcgtctttcccg

SEQ ID NO: 345988 - DNA, 523 bp, Homo sapiens
  misc_feature: GZ8MTXP02FHZVA.45.36.D03.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (470)..(470): a, c, t, g, unknown or other
  misc_feature (470)..(470): n is a, c, g, or t
  modified_base (519)..(519): a, c, t, g, unknown or other
  misc_feature (519)..(519): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccacctctcctgcagggccagtaggagtgtcagtaagtacttaggctggtaccaanagaaacctggccaggctcccaggctcctcatccatgatgcatccaaacncgggtcccctgggcctcccagacaggttccnggccagtgggctggggacaggagttcactctcaccgtnagcagcctgagcctgatgtatttgctagtttactctgtctagcagtccgttccgccgacgcccgctctacgtttcggggcgggggtaccgnggggtcggacgagtgacgacgaacgtgtcggctgcgacagtctgtctcnctcc

SEQ ID NO: 345989 - DNA, 527 bp, Homo sapiens
  misc_feature: GZ8MTXP02HEH43.45.36.D03.1.454.CMB.2.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccnccaggttccaggcaaggggctggagtgggtggccctnatttccgaagatggaagtgagaaggcctactcagactccgtgaaggccgcttcaccatctccagagacaattccaagaatgtcctcttttgcaaatgaatagcctgagagttgagacagtctgtctattctgtgccagggggacagtctatgagtcnggttcgtagtgtaatcaactactatacctnatggacgtctggggacaaagggacctcggtcaccgtctccgcagcttccacaggccatcgtctcccngcnccctgcctcagacgcactcgg

SEQ ID NO: 345990 - DNA, 521 bp, Homo sapiens
  misc_feature: GZ8MTXP02GJ9UU.45.36.D03.1.454.CMB.2.raw
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggcctcctcatccatgatgcatccaangggtccctggcctcccagacaggttccgnggccagtgggtctggggacagagttcactctcaccgtnagcagcctgngctgatgtatttgctagtttactctgtcagtcagtcgttccgccacgcccgctctacgttcgggcgggggtaccgaggggtcgaggagtggacgacgaacgtggtacggctgcaccgatctgtctcacttccg

SEQ ID NO: 345991 - DNA, 511 bp, Homo sapiens
  misc_feature: GZ8MTXP02H3VUB.45.36.D03.1.454.CMB.2.raw
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (394)..(394): a, c, t, g, unknown or other
  misc_feature (394)..(394): n is a, c, g, or t
  modified_base (466)..(466): a, c, t, g, unknown or other
  misc_feature (466)..(466): n is a, c, g, or t
  modified_base (499)..(511): a, c, t, g, unknown or other
  misc_feature (499)..(511): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggggagacagccaccctctcctgcagggccagtaggagtgtcaacgnggttccgtggcaggtgggtctggggacaggagttcactctcaccgtnagcagcctggagcctgatgattttgctagtttacttntgtcagcagcccgttccgccacgccgtctcgtaccgtttcgggggcgggggacctagggggtgagngtggacgacgaaactggtggctggcacatctgtcttcattccttcccgcctatctgactcgatcgcgttcgnggacggcgggcgtcggacgaggcgactagacgnnnnnnnnnnnnn

SEQ ID NO: 345992 - DNA, 490 bp, Homo sapiens
  misc_feature: GZ8MTXP02I74SM.45.36.D03.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaanagaaacctggccaggctcccaggctcctcatccatgatgcatccaancgggtccctggctcccagacaggttccgngcngtggtcnggacagtntcactcncgacgtnancagctgacnctgatgtattgctattctntntngcacgcgtccgcncgccgctcgtcgtcggcgggtacgngggngagagngacgacgacgtgcgcngcnctactctcgtctctctcg

SEQ ID NO: 345993 - DNA, 525 bp, Homo sapiens
  misc_feature: GZ8MTXP02HOH63.45.36.D03.1.454.CMB.2.raw
  modified_base (380)..(380): a, c, t, g, unknown or other
  misc_feature (380)..(380): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagacgcgatcgacacgaccggtgctcgatttagctgcgtcacgatctctcttggggaggaactgctcagttaggacccagagggaaccatggaagcccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggccgtcccagacaggttccgtggccaggtgggtctggggacagagttcactctcaccgtnagcagcctgagctgatgattttgctagtttacttctgtctagcacggtccgttccgccgaccgcccgtctactacgtttccggggcgggggtaccaggggtggagagtggagacgaacgtgnggctgcacatcngtctcattccc

SEQ ID NO: 345994 - DNA, 575 bp, Homo sapiens
  misc_feature: GZ8MTXP02J0ZWG.45.36.D03.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggccaccctgtctctgtctccagggganacagcccaccctctcctgcagggccagtaggagtgtcagtaagtacttaggctggtaccaanagaaacctggccaggctccaggctcctcatcatgatgcatccaaacngggtcccctgggcctcccagaccaggttccgnggccaggtgggtctggggacaggtagttcacttctcacgtcagcacgcctggacnccgtgatgtatttgacttacgtttactgtgtcagcgcgtccgttccgcccgaccgccgccgtccgtaccggttccggggtccgggggtaccgggtacggggtacgggtacggaggtacggacggaacggtaacggtcggtcggtcgtcgcgacgtacgtcgtcgttcttcctactccg

SEQ ID NO: 345995 - DNA, 533 bp, Homo sapiens
  misc_feature: GZ8MTXP02JE37R.45.36.D03.1.454.CMB.2.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
  modified_base (467)..(467): a, c, t, g, unknown or other
  misc_feature (467)..(467): n is a, c, g, or t
  modified_base (525)..(525): a, c, t, g, unknown or other
  misc_feature (525)..(525): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcatccatgatgcatccaangggtccctggctcccagcaggtccgngccagtggtctggggacagagttcgactctcaccgtnagccagcctggacgcctgactgtatttgactagtttactctgtcagcgacgtcgttcccgcgacgccgctcgacgtttcgggcgggggaccnggggtcgagtacgtggacgacgtaacgtgtacggctcggctaccgatcgtgtcttacnctttcccg

SEQ ID NO: 345996 - DNA, 550 bp, Homo sapiens
  misc_feature: GZ8MTXP02JUGUV.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (312)..(312): a, c, t, g, unknown or other
  misc_feature (312)..(312): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggcctcctcatccatgatgcatccaacgngggtcccctgggcctcccagaccaggttccgnggcccaggtgggtctggggacaggnttcactctccaccgtcagcagcctggacgcctgatgtatttgcttagtttactctgtcagcaggtccgttcccgccacgcccgtcgtcgtacgttcggggaccgggggtaccgagggggtcggacggtagtcggagtacggaacgttggcggtccncgcgactntcgtgtcctctactccg

SEQ ID NO: 345997 - DNA, 559 bp, Homo sapiens
  misc_feature: GZ8MTXP02HWYCE.45.36.D03.1.454.CMB.2.raw
  modified_base (210)..(210): a, c, t, g, unknown or other
  misc_feature (210)..(210): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (435)..(435): a, c, t, g, unknown or other
  misc_feature (435)..(435): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccacctctcctgcagggccagtaggagtgtcagtaagtacttaggctggtaccaacagaaacctggccaggcctcccaggctcctcatccatgatgcatccaacagggtccctggcctcccagacaggttccccgnggccaggtgggtctggggacnggtagttcacttcctcaccgtcagcagccgtggacgcctgattgtattttgcttagtttacttnttgtcagtcacgtcgttcccgccgaccgccgtcgtcgtaccgtttcgggggaccgggggtaccgacggggtgggacgagtgggaacgacggaacgtggtggcgtcgcaccattctcgttcttcg

SEQ ID NO: 345998 - DNA, 624 bp, Homo sapiens
  misc_feature: GZ8MTXP02HQUKG.45.36.D03.1.454.CMB.2.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccagggganacagcccaccctctcctgcagggccagtaggagtgtcagtaagtacttaggctggtaccaacagaaacctggcccaggcctccccgaggcctcctcatccatgatgcatccaaacgacggggtcccctgggccgtcccaggacctaggttcccggtggccctaggtcggggtctaggggacaggtacgtttccaacgtctccgacccgtanacgcacgcctggacgtcctagtagtgttagttttcgacttagtttacttcgtagtacacgtcgtacgtccgtaccgaccgaccgccgccgttaccgtacggtttccggggaccgggggtaaccgaggggtacggacggtaggtaggaacgtacggtaacgtggtcggtacgtacgaaccgaccgtacgttcgtcgtttccttacttactcccg

SEQ ID NO: 345999 - DNA, 536 bp, Homo sapiens
  misc_feature: GZ8MTXP02GP3OL.45.36.D03.1.454.CMB.2.raw
  modified_base (447)..(447): a, c, t, g, unknown or other
  misc_feature (447)..(447): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctatcagactccgtgaaggccgcttcaccatctccagagacaattccaagaatgtcctctttttgcaaatgaatagcctgagagttgaggacacgtctgtctatttctgtgccagggggacatctatgagtctggttcgtagtgtaatcaactactactactcatggacgtntggggacaaagggacctcggtcaccgtctccgcagccttccaccaagggcccatcggtcctccctggccncctgctcngacncactcgg

SEQ ID NO: 346000 - DNA, 671 bp, Homo sapiens
  misc_feature: GZ8MTXP02IFVHQ.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaccaacaagaacctggccaggcctccagctctcatccatgatgcataccaacgtacggggtcccctggggcccgttaccccgaaggaccgtacggggtttcccggtgggccccgtagggttcggggtcgtaggggacaggtacgtttccaacttcctcccgacccgttcaggacctacggccctgggacgtcccgtagtacgttgttaagttttcgacgttaacgtttttaccttcgttcgtaccgtaggtcctacggttccgttcccgacccgaccgtccgtaccgtccgttacccggtttccgggggaccgggggtacccgtagggggacggtagaacgtggaaacgtacggaacgttcggtacggcgtacggaaccgtacacgttcgttcggttccttacgtacttccccg

SEQ ID NO: 346001 - DNA, 570 bp, Homo sapiens
  misc_feature: GZ8MTXP02ILTRB.45.36.D03.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
  modified_base (510)..(510): a, c, t, g, unknown or other
  misc_feature (510)..(510): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtcttaggctggtaccaanagaaacctggccaggcctcccaggcctcctcatccatgatgcatcccaaacgngggtcccctgggcctacccagacctagggttcccgtggccctaggtggggtcctggggacctaggacgtttccaccttctacccgaccggtcaaggccacgcccgtggacgcctgattgtatttgctagttttactcgtgtcagctacggccgttcccgcctaccgcccgctcgtacgttcgggcgggggaccgnggggtggaggagtggacgacgaacgtcgtcggcgtgcaccgtatctgtcttcacttcccg

SEQ ID NO: 346002 - DNA, 559 bp, Homo sapiens
  misc_feature: GZ8MTXP02JLZFK.45.36.D03.1.454.CMB.2.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacngggtccctgggctcccagaccaggttcccgtggcccaggtgggtctggggacaggagttcactctcaccgtnagcagcctggagcctgatgtatttgctagtttacttctgtcagcacgtcgttccgccaccgccacctccgtacgtttccggggaccggggggtaccgtagggggtaggtaggacgtggaacggtacggaaaccgtggtcggcctggccacgtacgtcgtcgtctttctactttcccg

SEQ ID NO: 346003 - DNA, 550 bp, Homo sapiens
  misc_feature: GZ8MTXP02FZ05C.45.36.D03.1.454.CMB.2.raw
  modified_base (263)..(263): a, c, t, g, unknown or other
  misc_feature (263)..(263): n is a, c, g, or t
  modified_base (345)..(345): a, c, t, g, unknown or other
  misc_feature (345)..(345): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacgcgggtcccctgggccgtcccagaccaggttccgnggcccaggtcggggtctggggacaggacgttcactctcaccgtnagcagcctgagcctgatgtatttgctagtttacttctgtctagcgtacggtccgtttcccgcccgaccgtcccgccttccgtacgtttccggggcgggggtaccgaggggtggagagtgagacgacgtggtcggctcgcgaccactctgtctcacttcccg

SEQ ID NO: 346004 - DNA, 523 bp, Homo sapiens
  misc_feature: GZ8MTXP02JGB6I.45.36.D03.1.454.CMB.2.raw
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
  modified_base (378)..(378): a, c, t, g, unknown or other
  misc_feature (378)..(378): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtacccaacagaaacctggccaggctcccaggctcctcatccatgatgcatccaacngggtccctggccgtcccagcaggttccgnggccaggtgggtctggggacagagttcactctcaccgtnagcagcctggacgcctgatgtatttgctagtttacttcgtgtcagcagtccgttccgccacgccgctcacgtttcgggcgggggtaccaggggtcgagagtgacggacgaacgtgtcggctgcacgactctgtcttcgacttccg

SEQ ID NO: 346005 - DNA, 530 bp, Homo sapiens
  misc_feature: GZ8MTXP02F8JUH.45.36.D03.1.454.CMB.2.raw
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (469)..(469): a, c, t, g, unknown or other
  misc_feature (469)..(469): n is a, c, g, or t
  modified_base (497)..(497): a, c, t, g, unknown or other
  misc_feature (497)..(497): n is a, c, g, or t
  modified_base (524)..(524): a, c, t, g, unknown or other
  misc_feature (524)..(524): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacgngggtcccctggcctcccagacagggttcctggcccaggtgggtctggggacagagttcactctcaccgtnagcagcctggagcctgatgtatttgctagtttacttctgtcagcagtcgttccgccacgccgctcgacgtttcgggcgggggtaccgnggggtcggacgagtggacgacgttacgnggtcggcgtcgcgacactctgtcttcncttccg

SEQ ID NO: 346006 - DNA, 566 bp, Homo sapiens
  misc_feature: GZ8MTXP02HJL4Q.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcctcatccatgatgcatccaacgagggtcccctggccgtcccagacctaggttccgnggcccaggtgggtctggggacaggagttcactctcaccgtcagcagcctggacgcctgatgtattttgctagtttacttctgttcagtcacgtcgttcccgccgtaccgcccgtctccgtaccgtttcggggaccgggggtaccgtagggggtcggtaggacgtggacggacggaacgtggtcggtcgtcggcctaccgactcgtgtccttcgtacttcccg

SEQ ID NO: 346007 - DNA, 543 bp, Homo sapiens
  misc_feature: GZ8MTXP02GU19I.45.36.D03.1.454.CMB.2.raw
  modified_base (248)..(248): a, c, t, g, unknown or other
  misc_feature (248)..(248): n is a, c, g, or t
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtgccctnatttccgaagatggaagtgagaaggcctactcagactccgtgaagggccgcttcaccatctccagagacaaattccaaagaatgtcctcttttgcaaaatgaaatagctgagagttgaggacacgtctgtctatttctgtgccagggggacatcatgagtctggttntagttagtaatcaaactactactacctacatggaacgttcnggggacaaaagggaccctggtcacgtctcgcagcttcacaaggcccatcggtcttccccnggcccnccgtcncncacgacgcactcg

SEQ ID NO: 346008 - DNA, 566 bp, Homo sapiens
  misc_feature: GZ8MTXP02HSAKT.45.36.D03.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgcagtaagtacttaggctggtacaanagaaacctggccaggcctcccgagctcctcatccatgatgcatccaancgggtcccctgggcctcccagacgtaggttccgtggccaggtcgggtctggggacaggagttccactctcacccgtnacgcagcctgacgcctgatgtattttgacttagtttacttctgtacagtctacggtccgttccgccacgcccgtctacgtaccgtttcggggccgggggaccgaggggtggacggtagtggaacgacggaacgtggtacggctggaacctacgacgttctcgttccttactactttcccg

SEQ ID NO: 346009 - DNA, 554 bp, Homo sapiens
  misc_feature: GZ8MTXP02HADVC.45.36.D03.1.454.CMB.2.raw
  modified_base (202)..(202): a, c, t, g, unknown or other
  misc_feature (202)..(202): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccgaggcctcctcatccatcgatgcatcccaacgcggggtcccctgggcctcccagacctagggttccgnggccaggtgggtctggggacaggcgttcactctccgaccgtnagcagcctggacgcctgatgtatttgcttagtttactntgtcagtcagtccttccgccacgccgctcgtaccggttcgggggccgggggacctagggggtcggagacgtggaacgacgaacgttggcggctaggccaaccgtgtctgtccttcacttcccg

SEQ ID NO: 346010 - DNA, 529 bp, Homo sapiens
  misc_feature: GZ8MTXP02JSXUG.45.36.D03.1.454.CMB.2.raw
  modified_base (380)..(380): a, c, t, g, unknown or other
  misc_feature (380)..(380): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaaggccgcttcaccatctccagagacaattccaagaatgtcctctttttgctaaatgaatagcctgagagttgaggacacgtctgtctntttctgtgccagggggacatctatgagtctggttcgtagtgtaatcaactactactacctcatggacgtcgtgggacaaagggacctcggtacaccgtctccgcagctcacaggccatcgtctccctgcncctgctcagacncactcgg

SEQ ID NO: 346011 - DNA, 545 bp, Homo sapiens
  misc_feature: GZ8MTXP02GOEMJ.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcctcatccatgatgcatcccaaagcgggtcccctgggccgtcccagacctagggttcccgtggcccaggtcgggtctggggacngagttcactctcaccgtnagcagctgganctgntgtatttgctagtttactcgtgtcagcagtccgttcccgcctacgcccgtctcgtacgtttcggggccgggggtaccgaggggtcgaggagtggacgacgaacgtgtacggctgaactacgatctgtcttcgacttcccg

SEQ ID NO: 346012 - DNA, 552 bp, Homo sapiens
  misc_feature: GZ8MTXP02I0323.45.36.D03.1.454.CMB.2.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaacagaaacctggccaggctcccaggctcctcatccatgatgcatcccaagacgggtcccctggccgtacccagactaggttccgtggcccagtgggtctggggacagagttcactcncaccgtnagcagcctganctgatgtatttgctagtttactctgtcagcacgtcgttccgccacgcccgctaccgtaccgtttcggggccgggggtaccgaggggtgggaacggtagtaggacggaaacggtaacgtggtaggctaggaacgacactcgtgtcttacacttcccg

SEQ ID NO: 346013 - DNA, 550 bp, Homo sapiens
  misc_feature: GZ8MTXP02IJZ7J.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtactaggctggtaccaacagaaacctggccaggctccccaggcctcctcatccatgatgcatccaacgtacggggtcccctgggccgtcccagacgtaggtccgtggcccaggtgggtcgtaggggacaggtcgttcgacttcgtccaccgtcaggcagccgtggacgccgtgatgtacttttgcttagtttacttctgtctagtcagtccgttccgccgacgccgctcgtacgttcgggcggggacgacgggtggacgagtgacgacgtaacgtgtacgctcgctacgactctgtctactctcccg

SEQ ID NO: 346014 - DNA, 521 bp, Homo sapiens
  misc_feature: GZ8MTXP02I2KFQ.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcctcatccatgatgcatccaangggtcccctggcctccagacnggttccccgnggcaggtgggtctggggacnggagttcactctcacgtcagcagcctggagcctgatgtatttgctagtttacttctgtcagcacgtcgttccgccacgccgctcacgtttcgggcgggggaccgacgggtggagagtgagacgaacgtgtggcgtgcaccgatctgtctttc

SEQ ID NO: 346015 - DNA, 527 bp, Homo sapiens
  misc_feature: GZ8MTXP02F9YK1.45.36.D03.1.454.CMB.2.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (511)..(511): a, c, t, g, unknown or other
  misc_feature (511)..(511): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccacctctcctgcagggccagtaggagtgtcagtaagtacttaggctggtaccaacagaaacctggccaggctcccaggctcctcatccatgatgcatccaacngggtcccctggcctcccagaccaggttccgnggcccaggtgggtctggggacaggngttcactctcaccgtnagcagctgagcctgatgtatttgctagtttactcgtgtcagcagtccgttccgcctacgcccgctctacggtttcgggccgggggaccgtaggggtcggagagtggacgacgacgtgtcggctgcacgntctgtctactcttccg

SEQ ID NO: 346016 - DNA, 569 bp, Homo sapiens
  misc_feature: GZ8MTXP02G7NTQ.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcctcatccatgatgcatccaanacgggtccctgggcgtcccagacctaggttccgnggccctaggtcgggtctggggacaggtacgttcgactctcgaccgtnaggcagcctggacgcctgatgtatttgcttagtttactctgtcagtcacgtcgttacccgcctacgcccgtctcgtacggtttccggggcgggggtaccgaggggtcggacgtagtggacggacgtaaacgtgggtcggtctggaacctaccgtagtcctgtccttcgactttccccg

SEQ ID NO: 346017 - DNA, 553 bp, Homo sapiens
  misc_feature: GZ8MTXP02FWJAK.45.36.D03.1.454.CMB.2.raw
  modified_base (439)..(439): a, c, t, g, unknown or other
  misc_feature (439)..(439): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtgccctcatttccgaagatggaagtgagaaggcctactcagactccgtgaagggccgcttcaccatctccagagacaattccaagaatgtcctcttttgtaaatgaatagcctgagagttgagacacgtctgtctatttctgtgccagggggacagtctatgagtctggttcgtagtgtaatcaactactactacctnatgacgtctagggcaaagggacctcggtcaccgtctaccgcacgcttccaccaagggcccactcggtcttcccccgtgccgccctgcctccgacggacgcgacctcgtcggggg

SEQ ID NO: 346018 - DNA, 486 bp, Homo sapiens
  misc_feature: GZ8MTXP02I7DW9.45.36.D03.1.454.CMB.2.raw
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (454)..(454): a, c, t, g, unknown or other
  misc_feature (454)..(454): n is a, c, g, or t
  modified_base (474)..(486): a, c, t, g, unknown or other
  misc_feature (474)..(486): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcaacgaggttccgtggcaggtgggtctggggacagagttcactctcaccgtcagcagcctggagcctgatgattttgctagtttactctgtcagcagtcccgttccgccacgccgtctccgacgtttcggggcgggggacaggggtgagntgagacgatgngctgcacntctgtctcattcctcccgctatctgatcgatcgcgtcgtgacgcgggntcggacaggccgactagtgnnnnnnnnnnnnn

SEQ ID NO: 346019 - DNA, 550 bp, Homo sapiens
  misc_feature: GZ8MTXP02F5N1D.45.36.D03.1.454.CMB.2.raw
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaacagaaacctggccaggcctcccaggctcctcatccatgatgcatcccaacgacgggtcccctgggccgtccccagaccaggttccgnggcccaggtggggtctggggacaggagttcactctcaccgtnagcagccgtggacgcctagattgtatttgctagtttacttctgtcagcacgtcgttcccgcctacgcccgctacgtaccgtttcggggccgggggtaccgagggggtggaggagtggacgacgaacgtgtcggctgcaccgatctgtctcacttcccg

SEQ ID NO: 346020 - DNA, 558 bp, Homo sapiens
  misc_feature: GZ8MTXP02GQLZH.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctctcatccatgatgcatccaacacgggtccctggcctcccagactaggttccccgnggccagtgggtctggggacngagttcactctcaccgtnagcagccgtgacgcctgatgtatttgctagtttacttcgtgttacagtcacgtccgtttcccgccgtacgcccgtctccgtacgtttccggggcggggggtaccgaggggtacggaggtacgtggaacgacggtaaacgtggtcggcgtcgacacctagtctcgtcttc

SEQ ID NO: 346021 - DNA, 555 bp, Homo sapiens
  misc_feature: GZ8MTXP02G0AGJ.45.36.D03.1.454.CMB.2.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtacttaggctaggtaacaacagaaacctggccaggctcccaggctccncatccatgatgcatccaaacgacgggtcccctgggccgtcccagactacggttccgtggccctaggtggggtctggggacaggagttcacttccnccgaccgtgagcacgcccgtggacgtcctagatgtatttcgcttagtttactctgtacagctacgtccgttcccgaccacgcccgctcgtacggttcggggcggggacgngggtcggagngtggaagacgaagtggcgcgtgccaacgtactctgtctctactcccg

SEQ ID NO: 346022 - DNA, 564 bp, Homo sapiens
  misc_feature: GZ8MTXP02JMG5I.45.36.D03.1.454.CMB.2.raw
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggtgtgtcacaagatttgggctctgggcaccgtgggcatggggagcgttgtccagcctgggaggtccctgagactctcctgtgcagcctctggattctccctcagtaactttggtttccactgggtccnccaggttccaggcaaggggctggagtgggtgccctnattccgaagatggaagtgagaaggcctactcagactccgtgaagggccncttcaccatctccagagaccaattccaagaatgtaccttcttttgcaaatgaatagcctgagagttgaggacacgtctgtctattctgtgccgaggggacagtctatgagttctggttcgtagtgtaatcaactactactacctacatggacgtcgtaggggacgtaaacgggacctacggtaacgtacccgtcgtcccggactacggcctttaccaaacccgg

SEQ ID NO: 346023 - DNA, 575 bp, Homo sapiens
  misc_feature: GZ8MTXP02JDB4Q.45.36.D03.1.454.CMB.2.raw
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggtcaggctccaggctcctcatccatgatgcatccaacngggtccctggccgtccagacaggttccccgngcagtgggtctggggacnggngttcactctcaccgtnagcagcctggagcctgatgtatttgctagtttacttctgtcagtcacgtcgttcccgccgaccgcccgtcgtccgtaccgtttccggggaccgggggtacccgtagggggtacgggaaggtacggtaggaacggacggtaaacgtggtacgggccgtcggacctaccgagttccgttcgttactttccg

SEQ ID NO: 346024 - DNA, 570 bp, Homo sapiens
  misc_feature: GZ8MTXP02JRPZD.45.36.D03.1.454.CMB.2.raw
  modified_base (201)..(201): a, c, t, g, unknown or other
  misc_feature (201)..(201): n is a, c, g, or t
  modified_base (387)..(387): a, c, t, g, unknown or other
  misc_feature (387)..(387): n is a, c, g, or t
  modified_base (425)..(425): a, c, t, g, unknown or other
  misc_feature (425)..(425): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacaggggtcccctgggccgtcccagacctaggttccgtggcctaggtggggtctggggacaggagttcactctcaccgtnagcagcctggacgcctgatgtatttgactagtttactntgtcagtcagtccgttcccgcctacgcccgtctcgtaccggttcggggccgggggtaccgtagggggtcggaaggtcgtggacggtacggaacgttgggtcggctggaaccgtaccctaggtccttggtcctttcactttccccg

SEQ ID NO: 346025 - DNA, 572 bp, Homo sapiens
  misc_feature: GZ8MTXP02GORT8.45.36.D03.1.454.CMB.2.raw
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
  modified_base (387)..(387): a, c, t, g, unknown or other
  misc_feature (387)..(387): n is a, c, g, or t
  modified_base (557)..(557): a, c, t, g, unknown or other
  misc_feature (557)..(557): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccaggcctcctnatccatgatgcaatcccaacgcgggtcccctggccgtcccagacgtaggttcccgnggccaggtgggtctggggacagtagttcactctcaccgtnagcacgcctggagtcctgactgtatttgcttagtttacttcgtagttcgagtcgtacgtccgttcccgacccgaccgcccgcttccgtaccggtttccgggggcgggggtacccgtagggggtacggaggtagtaggacggacggaacgtggtcggctgctacgatcgtntccttctacttcccg

SEQ ID NO: 346026 - DNA, 520 bp, Homo sapiens
  misc_feature: GZ8MTXP02FTZ8Q.45.36.D03.1.454.CMB.2.raw
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagccaccctctcctgcagggccagtaggagtgtcagtaagtacttaggctggtaccaacagaaacctggccaggctcccaggctcctcatccatgatgcatccaacnggggtcccctgggcctcccagacaggttccgnggccaggtgggtctggggacagagttcactctcaccgtnagcagcctggagcctgatgtatttgctagtttacttctgtcagcagcgttccgccacgccgctcacgtttcgggcgggggaccgaggggtggagagtgagacgaacgtgtcggctgcacgactctgtcttcacttcccg

SEQ ID NO: 346027 - DNA, 585 bp, Homo sapiens
  misc_feature: GZ8MTXP02I6RA1.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (402)..(402): a, c, t, g, unknown or other
  misc_feature (402)..(402): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctggtaccaanagaaacctggccaggcctcccaggcctcctcatccatgatgcatcccaagcgggtcccctgggccgtcccagacgtacggttccgtggcctaggtcggggtctaggggactaggtacgttccgactctaccgaccgtnacgcagcccgtggacgcctgattgtattttgacttagtttactcgtgtacgagtctacggtccgttccccgccgaccgcccgctcgtacggtttcggggcgggggtaccaggggtcggagtacgtggaacggaacgacgttggcggtctcgaaccgacctagtctcgtccttctacttccccg

SEQ ID NO: 346028 - DNA, 585 bp, Homo sapiens
  misc_feature: GZ8MTXP02H5WK8.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaaccggaaaattgtgttgacacagtctccaggcaccctgtctctgtctccgagggganacagccaccctctcctgcagggccaggtaggagtgtcagtaagtacttaggctaggtaacaacagaaacctggccaggctcccaggctcctcatccatcgatgcactccaaacgacgggtcccctgggcctccgagacgaggttccgtggccctaggtgggtctaggggacaggtagttcacttctccgaccgtcagcacgccgtggacgcctgatgtattttgcttagtttacttctgtcagctacgtcgttcccgccaccggcccgtctccgtaccggttcggggccgggggaccgagggggtcggacgagtggaacggtaccggaaacgttcgggacggtcgtcgtccgacctacgtcgtcgttcttacttaccgttccg

SEQ ID NO: 346029 - DNA, 599 bp, Homo sapiens
  misc_feature: GZ8MTXP02JOSA4.45.36.D03.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggcctccncatccatgatgcatccaanacgggtccctgggcctcccagaccgaggttccgnggcccaggtggggtctggggacaggacgttcactctccaccgtcagccacgcctggacgccgtgatgtatttcgacttacgtttacttctgttcgagtcgacgtccgttcccgccgaccgcccgtcctcgtaccggtttccggggccgggggtaaccgtagggggtggaacggtaggtacggaacggaccggaaacgttgggtcggtcgtcggaacgaccgtacgttcgttcgtacctttccacgtttccccg

SEQ ID NO: 346030 - DNA, 568 bp, Homo sapiens
  misc_feature: GZ8MTXP02I2NLH.45.36.D03.1.454.CMB.2.raw
  modified_base (263)..(263): a, c, t, g, unknown or other
  misc_feature (263)..(263): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccaggtaggagtgtcagtaagtacttaggctggtaccaanagaaacctggccaggctcccaggcctcctcatccatgatgcatcccaacgcgggtcccctgggcctccccagacctacgggttccgtggccctaggtggggtctggggacaggtagttcacttctcaccgtcagcagccctggacgccgtgacttgtattttgcttagtttacttcgtgtcagtcacgtccgttcccgcctaccgcccgctcgtacggtttcgggcgggggaccgagggggtcggaggagtaggacggacgaacgtggcggcgtcggcaccgtagtctgtcttcgtactttcccg

SEQ ID NO: 346031 - DNA, 559 bp, Homo sapiens
  misc_feature: GZ8MTXP02JCJ8L.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggcctcctcatccatgatgcatccaaacgcggggtcccctgggcctcccagaccgtagggttcccgtggccctagggtcgggtctggggacaggtacgttcacttctccgaccgtcaaggcacgccgtggacgccgtgatgtatttgctagtttactcgtgtcagctagtcgttccgccacgccgctcgtacggtttcgggcgggggtacgaggggtcggacgtagtaggacggacgaacgtggtcggctgcacgtactctgtctctacttcccg

SEQ ID NO: 346032 - DNA, 543 bp, Homo sapiens
  misc_feature: GZ8MTXP02HTCJR.45.36.D03.1.454.CMB.2.raw
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
  modified_base (384)..(384): a, c, t, g, unknown or other
  misc_feature (384)..(384): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaanagaaactggccaggctcccaggctcctcatccatgatgcatccaaangggtcccctgggccgtcccagactaggttccgtggcccaggtgggtctggggacaggagttccactctcacccgtnagcagcctggacgcctgattgtattttgctagtttacttctgttcagtcagtcgttccgccaccgccgcctcgacgtttcgggcgggggaccgaggggtcggacgtagtggacgacgaaacgtggtcgcgtgccgaccattctgttcttctacttcccg

SEQ ID NO: 346033 - DNA, 614 bp, Homo sapiens
  misc_feature: GZ8MTXP02HTPP3.45.36.D03.1.454.CMB.2.raw
  modified_base (321)..(321): a, c, t, g, unknown or other
  misc_feature (321)..(321): n is a, c, g, or t
  modified_base (390)..(390): a, c, t, g, unknown or other
  misc_feature (390)..(390): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggcctcctcatccatgatgcatccaacgcgggtcccnggccgtcccagacaggttccgtggccctaggtgggtctggggacacggagttccacttctcgacccgtnacggcacgccctggacgtcctagatgtagttttcggccttaggttttacttcttcggtactagtcgtacgtccggttcccgcccgtaccgcccggccttccgtaccggtttcgggggccggggggtaaccgagggggttcgggacggtaggttcggaacggaccggtaaacgtgggtcggcgtacggccaccgacttccgtcggttctttcctacgtttccccg

SEQ ID NO: 346034 - DNA, 588 bp, Homo sapiens
  misc_feature: GZ8MTXP02J070R.45.36.D03.1.454.CMB.2.raw
  modified_base (397)..(397): a, c, t, g, unknown or other
  misc_feature (397)..(397): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaaccctggaccaggcctcccgaggcctcctcatccatgatgcatccaacgcgggtcccctgggccgtccccagaccgtagggttcccgtggcccgtaggtgggtctggggacaggtgttcactctcaccgtnagcacgccgtggacgcctgacttgtagtttgacttagtttacttactgtcagtcgacgtccgttcccgccgaccgtcccgtccgttccgtaccggtttccggggaccgggggtaccgtagggggtcggaggacggtaggacggacgtaacgtggcggtactcgcgaccgcgtcttcgtcttactcttcccg

SEQ ID NO: 346035 - DNA, 761 bp, Homo sapiens
  misc_feature: GZ8MTXP02HFYWR.45.36.D03.1.454.CMB.2.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtactaggctggtacaacagaaacctggaccaggcctcccgaggcctcctcatccatgatgcactaccaacgtacgggtcccctgggccgtacccagaccgtacgggttccgnggccctagggtcgggtcgtaggggacaggtacgttccacttcctaccgtacccgttcgacggccgaacgggtcccgttagggggaacctcccgttagggaacgtttagggtttaactttttcggacccgtttaaaggtttttaacccttccgttggttaccgtaacgggtccgtaaccgggtttccccgttccccggacccggaaccccggtccccggttccttacccgggttacccggggttttccggggggacccgggggggtaaccgtacggggggttacgggaaacggtacggttacggggaaaccggaaccgggttaaacggtggggttaccgggccgttacgggaacccttaaccggtacttcccggttagtttacccgttccttaccgtttcccccgg

SEQ ID NO: 346036 - DNA, 672 bp, Homo sapiens
  misc_feature: GZ8MTXP02JKDTG.45.36.D03.1.454.CMB.2.raw
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccagctcccgagctcctcatccatgatgcatccaacgcgggtcccngggccgtccagacgtaggttccgnggcccgtaggtcgggtctggggacaggtagttccactctcaccgtnacgcacgccgtggacgcctgatgtattttcggcttacggtttaccttcgtgttacgagtcgtacggtccggttccccgcccgtaccggtcccgtaccgttaccgtaccgggttttcccgggggaccggggggtaaccgtacggggggtacgggtaacgggtacgggttacggaaacgggtaaccgggtaaaccggttcggggtacggggtcccggttacggaacccgtacccgttaacgttcccggttacggtttaccctttcccggtaacttttccccccgg

SEQ ID NO: 346037 - DNA, 628 bp, Homo sapiens
  misc_feature: GZ8MTXP02GPS4M.45.36.D03.1.454.CMB.2.raw
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccgagcctcctcatccatgatgcatcccaacgcgggtcccctgggccgtacccagaccgaggttccgtggcccaggtggggtctggggacaggtacgttccgactctccgaccgtnacgctagcctgggacncgtgagtgttattcgacttagtttactcgtgtacagtaccgtacgttccgttcccgaccgtaccgcccgtcgtaccgttaccgggtttccgggggaccgggggtaccgtagggggtacggaacggtacggtaggaaacggtaaccgtaacggtcggtacggtcgtacggaaccgtaccgtacgttccgttacgttacccgttacgtaccgtttcccg

SEQ ID NO: 346038 - DNA, 601 bp, Homo sapiens
  misc_feature: GZ8MTXP02JXOLA.45.36.D03.1.454.CMB.2.raw
  modified_base (263)..(263): a, c, t, g, unknown or other
  misc_feature (263)..(263): n is a, c, g, or t
  modified_base (353)..(353): a, c, t, g, unknown or other
  misc_feature (353)..(353): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaccaanagaaacctggccaggcctcccaggcctcctcatccatgatgcatcccaacgcggggtcccctgggccgtcccaggacctagggttcccgnggccctaggtggggtctggggacaggtacgttcacgtctaccgaccgtcaagcacgcccgtggacgcctgatgtatttgactagtttctcgtgtctagctacggtccgttcccgccgtaccgcccgtcttaccgtaccggtttccgggggaccggggggacccgtagggggtggaacggtagtaggacggaacgtaacgtgggtcggactcggaaccacccgtagtcgtcgttcttacgactttcccg

SEQ ID NO: 346039 - DNA, 609 bp, Homo sapiens
  misc_feature: GZ8MTXP02JFWNU.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggcctcctcatccatgatgcatcccaacgacggggtcccctgggccgtaccccagtaccgtagggttcccgtggccctaggttgggtccgtggggaacaggtagttccacttcctacgacccgtcaaggccacgtcccgtaggacgtacctgatgtatttgacttagtttacttctgtcagtcacgtccgttccgccgaccgtccgtccgtcgtaccgtttcggggccgggggtaccgaggggtcggagtacgtggacggacgtaacgtggtacggcgtacggaaccgtacccgtaagttccgtacgttcctttcgactttcccg

SEQ ID NO: 346040 - DNA, 539 bp, Homo sapiens
  misc_feature: GZ8MTXP02JT5ZZ.45.36.D03.1.454.CMB.2.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (391)..(391): a, c, t, g, unknown or other
  misc_feature (391)..(391): n is a, c, g, or t
  modified_base (532)..(532): a, c, t, g, unknown or other
  misc_feature (532)..(532): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagcccacctctcctgcagggccaggtaggagtgtcagtaagtacttaggctggtaccaanagaaacctggccaggctcccaggctcctnatccatgatgcatccaacgngggtcccctgggcctcccagacaggttccgngccagtgggctggggacagattcactctcaccgtnagcacgcctggacncctgatgtatttgctagtttacttcgtgtcagcagtccgttccgccacgcccgctccgtaccggtttccggggccgggggaccagggggtggacggagtggaaggacgaacgtggacggctacgcaccgatcgtgtctacncttcccg

SEQ ID NO: 346041 - DNA, 634 bp, Homo sapiens
  misc_feature: GZ8MTXP02H4ZK0.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
tcagacgcgatcgacacgaccggtgctcgatttagctgcgtcacgatctctcttggggaggaactgctcagttaggacccagagggaaccatggaagcccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctggtaccaanagaaaccnggccaggcctcccgaggcctcctcatcccatgatgacactaccaacgacggggtcccctgggccgtaccccaggaaccgtacggggtttcccgtggccccgtagggttcggggtcctaggggacctaaggtacgtttccaaccgttcctcccgaacccgtcacggccacgcccgtggcgtccctagtacgtgttagttttcgactttagtttaccttcgtgttcagcgtacggtccgttcccgcccacgcccgtctaccgtaccggtttcgggggaccgggggaccgtagggggtcggacggagtaggaacgacggaacgttggcggcgtacgccaccgtatcgttcgttctactcgttcccg

SEQ ID NO: 346042 - DNA, 610 bp, Homo sapiens
  misc_feature: GZ8MTXP02JR3L8.45.36.D03.1.454.CMB.2.raw
  modified_base (211)..(211): a, c, t, g, unknown or other
  misc_feature (211)..(211): n is a, c, g, or t
  modified_base (581)..(581): a, c, t, g, unknown or other
  misc_feature (581)..(581): n is a, c, g, or t
  modified_base (599)..(599): a, c, t, g, unknown or other
  misc_feature (599)..(599): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggcctcccgaggcctcctcatcccatgatgcactccaacgtcggggtcccctgggcccgtaccccaggaccgtacggttccccgtggcgtagggtcggggtccgtaggggacagggtacgttcaccgttcctcgacccgtcagcacgcccgtggacgccgtgactgtattttcgacttagtttcttcgtgttcgagtctacggtcccgttaccgccgtacgcccgtctccgtacggtttccgggggcgggggtaccgtagggggtacggagacgtaggacggtaacgtacgttggngtaaccgtggacaccgtnttcgtcgtctc

SEQ ID NO: 346043 - DNA, 565 bp, Homo sapiens
  misc_feature: GZ8MTXP02IP9EC.45.36.D03.1.454.CMB.2.raw
  modified_base (250)..(250): a, c, t, g, unknown or other
  misc_feature (250)..(250): n is a, c, g, or t
  modified_base (381)..(381): a, c, t, g, unknown or other
  misc_feature (381)..(381): n is a, c, g, or t
  modified_base (443)..(443): a, c, t, g, unknown or other
  misc_feature (443)..(443): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaacttttggtttccactgggtccgccaggttccaggcaaggggctggagtgggtggccctnatttccgaagatggaagtgagaaggcctactcagactccgtgaaggccgcttcaccatctccagagacaattccaagaatgtcctctttttgctaaatgaatagcctgagagttgagacacgtctgttctntttctgtgccgagggggacatctatgagttctggttcgtagtgtaatcaatactactacctntatggacgtgtcggggacgaaacgggcctcgggtcaccgtctccgcagccttaccaccgagggcccagtccggtccttcccccgtggcccgtcccgtcgcctccgaggacgccaccgtccgg

SEQ ID NO: 346044 - DNA, 520 bp, Homo sapiens
  misc_feature: GZ8MTXP02JWBTX.45.36.D03.1.454.CMB.2.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
  modified_base (385)..(385): a, c, t, g, unknown or other
  misc_feature (385)..(385): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccgaggctcctcatccatgatgcatccaacgcgggtcccctgggccgtcccagacaggttccgnggccaggtgggtctggggacagagttcactctcaccgtnagcagcctgacgctgatgtatttgctagtttactctgtcagcagtcgtccgccacgccgctctacgttcgggcgggggaccgagggtcggagagtggagacgaacgtgtggctgcgacatctgtcttcacttccg

SEQ ID NO: 346045 - DNA, 629 bp, Homo sapiens
  misc_feature: GZ8MTXP02HWGK0.45.36.D03.1.454.CMB.2.raw
  modified_base (249)..(249): a, c, t, g, unknown or other
  misc_feature (249)..(249): n is a, c, g, or t
  modified_base (378)..(378): a, c, t, g, unknown or other
  misc_feature (378)..(378): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaacttttggtttccactggtccgccaggttccaggcaaggggctggagtgggtggccctnatttccgaagatggaagtgagaaggcctactcagactccgtgaaggccgcttcaccatctccagagacaattccaaagaatgtacctcttttgcaaatgaatagcctgagagtgagacacgtctgtctntttctgtgccagggggacatctaatgagtgtggttcgtagtgtaatctaactactactacctacatggaacgtcgtggggacaaacggggacctacgggtacaacccgtcttacccggcaacggtcctttacccgaaacccgtaaacgggggacccccaaagtcccgggttcccgtttcccccccgttcgggtccccgggcccccttcggcccttcccgaacgggaaccggtcccaacccttccccggggg

SEQ ID NO: 346046 - DNA, 585 bp, Homo sapiens
  misc_feature: GZ8MTXP02I1NGL.45.36.D03.1.454.CMB.2.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggctcccaggcctccncatccatgatgcatccaacgcgggtcccctgggcctacccagactaggttccgnggccctaggtcgggtctggggacaggacttcactcncgaccgtnagcagctgacncgtgatgtatttcgacttagtttactctgtcagtcacgtccgttccgaccgaccgccgtctcgtaccggtttcggggccgggggtaccgagggggtcggaggtacgtaggaacggtaacggaacggtcggtacgggtctacggcccaaccgtacgttccgttcgttccttccgtacgtttccccg

SEQ ID NO: 346047 - DNA, 812 bp, Homo sapiens
  misc_feature: GZ8MTXP02IXIH3.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctggtaaccaacagaaacctggaccaggcctacccgaggcctcctcactccatgatgacactcccaaacgtcggggtcccctagggccctacccgaggaccgtacgggtttccccggtggaccccgtaggggttcggggtccgtagggggaacaagggtacgtttcccgaaccgttccgtacccgtaacccggttccgaacggcccaacggtcccccgttaggggaaccggtccccgttagggtaagtttcggtttaagtttttcggaacgtttaacggtttttaaccttcgtttacggttaccgtaacggtcccgtaacgggttccccgtttaccccgccccggaaccccggtccccggtccgtttacccggtaacccggggttttcccggggggacccgggggggtaacccggtaaggggggttacgggaaacgggtacggttaacggggaacgggtaaaacccggtaaacggttcggggtaccgggtcccggttacggaaccccgtaacccggtaacgttcccgttcggtttaccctttccgtaaccttttcccccgg

SEQ ID NO: 346048 - DNA, 764 bp, Homo sapiens
  misc_feature: GZ8MTXP02I4CTH.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagtaagtacttaggctggtaaccaacagaaacctggccaggcctcccaggcctcctcactccatgatgacatacccaacgacggggtcccctgggcccgtacccaggaccgtcgggttcccggtggacccgtagggttcgggtcgtaggggacgaggtacgtttccaccgttccgtaccgacccgttcgacgtacccgacggtcccgttgggaaccgtcccgttagggaatttcggttaactttttcggaaccgtttaacggtttttacctttcgttacggtttaccgacggttcgtaaccggttcccggtttacccccgcccggtaacccggtcccccgtcgttaccccggttaaccgggttttccccgggggaccggggggttaaccccgtagggggttacgggaccggtaaggttacgggaaaccgggtaaaccggtaaaccggttgggtaccggtccgttacgggaaccctaacccgtaacgtttccgccggtttaccgtttacctacgttttcccccgg

SEQ ID NO: 346049 - DNA, 570 bp, Homo sapiens
  misc_feature: GZ8MTXP02INPA4.45.36.D03.1.454.CMB.2.raw
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtcttaggctggtaccaanagaaacctggccaggctcccaggcctccncatccatgatgcatcccaacacgggtcccctgggccgtccccagacaggttccgnggcccaggtcggtctaggggacagtacgttcactctccaccgtcagcagcctggacgccgtgatgtattttcgctagtttcttctgttcagtcacgtccgttcccgccgaccgccgtcctcgtcgttcggggccgggggaccgaggggtcggacggagtaggacggacgtaacgtggtacggtccgtgccgaacctacgttcgtgttcctttacacgtttccccg

SEQ ID NO: 346050 - DNA, 603 bp, Homo sapiens
  misc_feature: GZ8MTXP02GPSWU.45.36.D03.1.454.CMB.2.raw
  modified_base (478)..(478): a, c, t, g, unknown or other
  misc_feature (478)..(478): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaaccaacagaaacctggccaggcctcccgaggcctcctcatccatgatgcatcccaacgtcggggtcccctgggcccgtccccaagaccgtacggggttcccgtgggcccctagggtcggggtctaggggacaggtacgttccacgttctaccaccgtcaagcacgccctggacgcctgactgtatttgcttagtttactctgtcagctacgtccgttcccnccgaccgcccgtctccgtaccggtttcggggccgggggacctaggggcggagacgtaggacggaacgtaacgtggtacgcgtacggaaccgtaacctagttcctcgttccttcgtactttccccg

SEQ ID NO: 346051 - DNA, 601 bp, Homo sapiens
  misc_feature: GZ8MTXP02IJ397.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggcctccaggctcctcatccatgatgcactccaagacgggtcccctgggccgtcccagaccgtacggttccgtggcctaggtcgggtctaggggacaggtacgttcacttctaccgaccgtcagcacggcctggactcctgattgtattttcggacttagttttacttcgtgttacgacgtcgtacggtccgttcccgccgtaccgcccgtcttaccgtacggtttccgggggccgggggtacctagggggtcgaacgtagtaggacgtaacgacgttcggtacgctacggaactaccgattccgtagttcttacactttccccg

SEQ ID NO: 346052 - DNA, 662 bp, Homo sapiens
  misc_feature: GZ8MTXP02HAQDX.45.36.D03.1.454.CMB.2.raw
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
  modified_base (401)..(401): a, c, t, g, unknown or other
  misc_feature (401)..(401): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccaggtaggagtgtcagtaagtacttaggctggtaccaanagaacctggccaggcctcccaggcctcctcatccatgatgcatccaacgcgggtccccngggcctccagacgtggttccgnggcccgtaggtggggtctaggggactaggtacgttccacttcctaccgacccgtnaacggccacggtcccgtgggaccgtcccgtaggtacttaggttatttttcggactttaggtttttacctccgttggttcctaggtaccgtacggtcccgttcccgacccgtaccggccccgtccgtccgtaccgggtttccgggggaccgggggtaccgtgggggttacggaaggtcggtaggaacggtacgtaaaccggttgggtcggtaccgttcgcccgacgtacgttccgttcgtttccgttactacgtttcccccg

SEQ ID NO: 346053 - DNA, 600 bp, Homo sapiens
  misc_feature: GZ8MTXP02IMKND.45.36.D03.1.454.CMB.2.raw
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccacccctctcctgcagggccagtaggagtgtcagtaagtacttaggctggtaccaanagaaacctggccaggctccagcctccncatccatgatgcatccaagacgggtcccctgggccgtcccagaccgtacggttccgtggcccgtaggtcgggtcgtggggacaggtattccactctccaccgtcagcacgccgtggacgccgtgagttgtattttcgcttagtttacttcgtgtacagtcacgtccgttcccgccgtaccgcccgtctaccgtacggtttccggggacgggggtaccgaggggtcggaaggtagtaggaacggaacggtaacgtggtacggtcgtcggaaccacccgtagttccgtgttccttacgtacgtttccccg

SEQ ID NO: 346054 - DNA, 629 bp, Homo sapiens
  misc_feature: GZ8MTXP02I8Z3J.45.36.D03.1.454.CMB.2.raw
  modified_base (51)..(51): a, c, t, g, unknown or other
  misc_feature (51)..(51): n is a, c, g, or t
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
tcagacgcgatcgacacgaccggtgctcgatttagctgcgtcacgatctcncttgggggaggaactgctcagttaggacccagagggaaccatggaagccccagctcagcttctcttcctcctgctactctggctcccagataccaccggaaaaattgtgttgacacagtctccaggcatcctgtctctgtctccagggganacagccaccctctcctgcagggccagtaggagtgtcagtaagtacttaggctggtaccaacngaacctggccaggctcccaggctcctcatccatgatgcatccaacgacggtccctaggccgccccagacgtaggttccggcggcgtaggtcggtcgnggacagtcgactactcgtaccgaccgtcacgctacgtcgtaggacgtnacttcgtagaagtagtttacgtacgttacgtttacgtttcgttcgtcgtacgtcgacggaccgttcccgtcccgtaccgtcccggtccgttccgtaccggtttaccgggtaccggggggtacccggtacgggggtacggggtacggaacgtacggtacggacggtaaccgtacggtcgggtccgtcggtccgaccgtacgtcgttacgttaccgtttccg

SEQ ID NO: 346055 - DNA, 556 bp, Homo sapiens
  misc_feature: GZ8MTXP02FXN20.45.36.D03.1.454.CMB.2.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (476)..(476): a, c, t, g, unknown or other
  misc_feature (476)..(476): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccgagctcctcatccatgatgcatccaacngggtccctggcctccagacaggttccgtggcccaggtgggtctggggacagtacgttcactctcaccgtnagcagcctggacgcctgatgtatttgctagtttactctgtcagtcacgtccgttccgccgacgcccgtctcgtacggtttcgggcgggggtaccnggggtcgagtacgtggaacgacggtaacgtggtacgcgtcggaaccgactacgttccgtcgttcctactacgtttccccg

SEQ ID NO: 346056 - DNA, 584 bp, Homo sapiens
  misc_feature: GZ8MTXP02I3IAS.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctccnatccatgatgcatccaacngggtcccnggcctccagacaggttcccgngcagtgggtctgggacnggattcacgtctcgacgtcagcacgccgtggacgccgtgtactgtatttgactagtttacttcgtgttctagtctaggtccgttccgcctaccggcccgtccgttaccgtaccggtttccgggggaccggggggtaccggtacgggggttacgggaggtacggtaggaacggacgtaaacgtggtacggcgtacgccgtaccgacgtctcgttacttccg

SEQ ID NO: 346057 - DNA, 549 bp, Homo sapiens
  misc_feature: GZ8MTXP02IU30W.45.36.D03.1.454.CMB.2.raw
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtactaggctggtaccaanagaaacctggccaggctcccaggctcctnatccatgatgcatccaanacgggtcccctgggccgtacccagacgtgggttcccgtggccgaggtggggtctggggacagacgttccactctccaccgtcagcgagccgtgacgcctgattgtatttgctagtttacttctgttcagtcagtccgttcccgcaccgccgtactcgtacggtttcgggcgggggtacaggggtcgagcgtggacgtacgacgtggtacgctcgcaccgtatcgtgtacttcacgtttccc

SEQ ID NO: 346058 - DNA, 653 bp, Homo sapiens
  misc_feature: GZ8MTXP02INSJY.45.36.D03.1.454.CMB.2.raw
  modified_base (352)..(352): a, c, t, g, unknown or other
  misc_feature (352)..(352): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccccgtctctgtctccaggggagacagccaccctctcctgcatggccagtaggagtgtcagtaagtacttaggctggtaccaacagaaacctggccaggctcccaggcctcctcatccatgatgcatccaacgacgggtcccctgggccgtccccagaccgtaggtttcccggnggccgtaggtcgggtcgtaggggactaggtacgttccactcctaccgacccgtcagccgacgccgtggacgccgtgtattgttattttcgacttagtttcttcgtcgtctagtcgtacgttccgttcccgtccgacccgtccgtccgttaccggtaccgggtttccgggggaccgggggtaccgtagggggtacgggtacggtacggtacgggaaacggtaaaccggtaacggttcgggtacggtcgtaccggaaccgtacgtacgttccgttacgtttccgtttaccgtaccgtttcccg

SEQ ID NO: 346059 - DNA, 518 bp, Homo sapiens
  misc_feature: GZ8MTXP02FMX7X.45.36.D03.1.454.CMB.2.raw
  modified_base (201)..(201): a, c, t, g, unknown or other
  misc_feature (201)..(201): n is a, c, g, or t
  modified_base (465)..(465): a, c, t, g, unknown or other
  misc_feature (465)..(465): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacacgggtccctgggccgtcccagacaggttccgtggccagtgggtctggggacagagttcactctcaccgtcagcacgcctggacgcctgatgtatttgctagtttacttctgtcagcagtcgttccgccacgccgctcacgtttcgggcggggacnggggtgagagtgacgacgacgtgtcgctgcgaccatctgtcttcgacttcccg

SEQ ID NO: 346060 - DNA, 592 bp, Homo sapiens
  misc_feature: GZ8MTXP02JLI0Q.45.36.D03.1.454.CMB.2.raw
  modified_base (208)..(208): a, c, t, g, unknown or other
  misc_feature (208)..(208): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
tcagacgcgatcgacacgaccggtgctcgatttagctgcgtcacgatctctcttggggccctggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggctcccagctcctcatccatgatgcatccaaacagggtccctggcctcccagacaggttccccgngcagtggtcnggacngtacgtcactcnccaccgtnagcacgccgtggacgcctgatgtattttgcttagtttacttctgtcgtagtctacgtccggttccgccgtaccgcccgtcgtccgtaccggtttccgggggaccgggggtaacccggtagggggtacgggtaacggtacggtacgggaacggtaccggtaacgtggtacggtcgtacggacctaccgtacgttcgttacgttacttacg

SEQ ID NO: 346061 - DNA, 550 bp, Homo sapiens
  misc_feature: GZ8MTXP02GTY56.45.36.D03.1.454.CMB.2.raw
  modified_base (200)..(200): a, c, t, g, unknown or other
  misc_feature (200)..(200): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (533)..(533): a, c, t, g, unknown or other
  misc_feature (533)..(533): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgcatccaacngggtcccctgggcctcccagacctaggtccgnggccaggtgggtctggggacaggacgttcactctcaccgtnagcagcctggagcctgatgtattttgctagtttacttctgttacagcagtccgttccgccctaccgcccgtctccgaccgtttcgggccgggggtaccgacgggggtggacgagtaggacgacgtaacgtggtacggcctggcaaccgtntcgtcgtctctactccg

SEQ ID NO: 346062 - DNA, 521 bp, Homo sapiens
  misc_feature: GZ8MTXP02FHAB4.45.36.D03.1.454.CMB.2.raw
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccacctctcctgcagggccagtaggagtgtcagtaagtacttaggctggtaccaacagaaacctggccaggctcccaggctcctcatccatgatgcatccaaancgggtcccctgggccgtcccagacaggttcccgtggcccaggtgggctggggacagagttcactctcaccgtnagcagcctggagcctgatgtatttgctagtttacttctgtcagcagcgttcccgccacgcccgctcgtacgtttcgggcgggggaccgaggggtggagagtgacgacgaactgtggctgcaccatctgtctcattcccg

SEQ ID NO: 346063 - DNA, 584 bp, Homo sapiens
  misc_feature: GZ8MTXP02IX76G.45.36.D03.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttagggctggtaccaanagaaacctggccaggcctccaggcctcctcatccatgatgcatccaangggtcccctggcctcccagaccgaggttccgtggcccaggtcgggtctggggacagtacgttcactctcgacccgtcagccagcctggancctgatgtatttgctagtttactctgtcagtnacgtccgttaccgccgaccgcccgccttcaccggtttccgggggccgggggtaccctagggggtcggtaaggacgtagggaacgacggtaaacgtggtacggcgttcggaaccgtacctacgttccgtcttccgttacctacgtttccccg

SEQ ID NO: 346064 - DNA, 677 bp, Homo sapiens
  misc_feature: GZ8MTXP02G8IG5.45.36.D03.1.454.CMB.2.raw
  modified_base (211)..(211): a, c, t, g, unknown or other
  misc_feature (211)..(211): n is a, c, g, or t
  modified_base (362)..(362): a, c, t, g, unknown or other
  misc_feature (362)..(362): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggcctcccaggctcctcatccatgatgacatccaaacgcgggtccctggccgtaccccagtaccgtaggttccccgnggccaggtggggtctaggggacctagggtacgtttccgaaccttcctccgaaccgtcgaagccgtacgcccgtggacgtcccgtgattgtattttcgacttacgttttactttacgtcgttacgtacgtcgtacggtccggtttacccgcccgtacccgtcccgtccgttccgtacccgggttttccgggggacccggggggtaacccgtagggggtacgggaacgggtacggtagggaacggaccgggtaaaccggtggttacgggccgttcgggaccctaaaccggtacttcccgtttcggttccctttaccg

SEQ ID NO: 346065 - DNA, 700 bp, Homo sapiens
  misc_feature: GZ8MTXP02G0C7O.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaacctggccaggcctcccaggctcctcatccatgatgacatcccaagtacgggtcccctgggccgtcccagacctagggttcccgtggcccctaggtcgggtctggggacctaggtactttccgacttctaccgacccgtcaacggccaacggccctggacgtcgtacgaattgtacgttttcgacttagttttaccttcgtgttacgacgtaccgtaggtacccgtttcccggacccgtaccgtccccggtaccttacccggttcccgggtttttaccggggggacccgggggggtaacccgaaggggggttcgggaaggtacggttaggggaaaccggtaaaccgggtaaaccggtcgggttcggggaaccttcggaacccgtaaccccgtacgtttccggttcgtttacccgtttacctaacggtttcccccg

SEQ ID NO: 346066 - DNA, 748 bp, Homo sapiens
  misc_feature: GZ8MTXP02FYMP0.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaccaacagaaacctggccaggctcccaggcctcctcatccatgatgcatacccaaacgacggggtcccctgggcccgtccccgaaggaccgtagggtttccccggtgggccccgtagggttcggggtctagggggaacctaggtacggtttccaaccttccgttaccgaaccccggttcaaacgggccgaaggtcccgttaggggaacgtcccgttaggtacgttagttacgtttttggaccgtttaacggtttttacctttcgttcggttaccgtaacggtccgtacgggtcccgtttcccccggacccgtaacccggcccccggtccgttacccgtacccgggttttccgggggcccggggggttaacccgaggggggttacggaacgggtaggttacgggaacggaaaccggtaaaccgttcgggtacgggtccgttacggaaccgtaccctagttccgtacggttcctttaccgtactttccccg

SEQ ID NO: 346067 - DNA, 534 bp, Homo sapiens
  misc_feature: GZ8MTXP02II6OC.45.36.D03.1.454.CMB.2.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctccncatccatgatgcatccaangggtccctggctcccagacaggttccggcaggtggtctggacagtgttcactctacaccgtnagcagcgtgacgctgatgtatttgcttagtttacttctgtcagcacgtccgttccgccaccgccgctacgtacgttcggggccggggtacgaggggtggagagtggacgaacgaaacgtcggtcgcgtcgaaccgacctagtctagttccttactacttccc

SEQ ID NO: 346068 - DNA, 562 bp, Homo sapiens
  misc_feature: GZ8MTXP02IDYW0.45.36.D03.1.454.CMB.2.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaacctggccaggcctcccgaggctcctnatccatgatgcactccaagacgggtcccctgggcccgtcccagaccgtacggtttccgaggccctaggtcggggtctggggactaggacgtttcacttctccgaccgtcagcacgccgtggacgtcctggatgtattttgcttagtttactctgtcagtcagtcgttcccgcaccgtccgctcgcgttcgggcggggtaccgaggggtggacgtgtggagtacggaacgtgtcggtcgtcgcgtacagtcgtgtaaccttctacttcccg

SEQ ID NO: 346069 - DNA, 523 bp, Homo sapiens
  misc_feature: GZ8MTXP02GQU0D.45.36.D03.1.454.CMB.2.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaangggtcccctgggcctcccagacagggttccgtggcccaggtgggtctggggacagagttcactcncaccgtcagcagcctgagcctgatgtatttgctagtttactctgttcagcagtcgttccgccacgccgctcgtacgtttcgggcgggggaccaggggtggacgagtggacgacgaactggtcgctgcaccgatctgtcttcacttcccg

SEQ ID NO: 346070 - DNA, 603 bp, Homo sapiens
  misc_feature: GZ8MTXP02FTRK2.45.36.D03.1.454.CMB.2.raw
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctntcctgcagggccagtaggagtgtcagtaagtacttaggctggtaccaanagaaacctggccaggctcccgaggctcctcatccatgatgacatcccaaacgacggggttcccctgggccctcccgagaccgagggttcccgtggaccccaggtcgggtctggggacaggagttcactctcaccgtnagcagccgtgancctgatgtatttgactagtttacttgtcgttcagcagtccgttcccgaccgtaccgcccgccgttcctaccggtttccggggccgggggtaacccgtagggggtacggaggtacgtaggaacggtaacgtaaacgttggtcggctcggaaccgtaccacgttccgttagttccgttacctacgtttccccg

SEQ ID NO: 346071 - DNA, 565 bp, Homo sapiens
  misc_feature: GZ8MTXP02I88SE.45.36.D03.1.454.CMB.2.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
  modified_base (546)..(546): a, c, t, g, unknown or other
  misc_feature (546)..(546): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccaggctcctnatccatgatgcatccaacgngggtcccctgggccgtcccaggtacaggttccgtggccctaggtcggggtctaggggacaggtacgttcactctccaccgtcagctagccgtggacncctagattgtattttcgacttagtttactctgtacagtcacggtccgttcccgcctaccgcccgctaccgtcgtttccggggcgggggaccagggggtcgagtacgtaggacgacggacgttggacgctagctaacgntctgttctacactttcccg

SEQ ID NO: 346072 - DNA, 547 bp, Homo sapiens
  misc_feature: GZ8MTXP02GQ4CA.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
  modified_base (522)..(522): a, c, t, g, unknown or other
  misc_feature (522)..(522): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctccaggctcctcatccatgatgcatccaaacncgggtccctgggcctccccagacctaggttccccgnggctaggtcggggtctggggacaggtacgttcacgtcctccaccgtcagcacgcctggacgcctgatgtatttgctagtttacttcgtgtcagtctagtccgttccgccacgccgctcacgtttcgggcgggggaccaggggtcggagagtggacgacgaacgtggnggcgtcggacacatctcgtcttacg

SEQ ID NO: 346073 - DNA, 694 bp, Homo sapiens
  misc_feature: GZ8MTXP02JEBEK.45.36.D03.1.454.CMB.2.raw
  modified_base (211)..(211): a, c, t, g, unknown or other
  misc_feature (211)..(211): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacgagaaacctggaccaggcctcccgaggcctcctcatccatgatgcatccaacgcgggtccctggcctccagacgtaggttccccgtggcgtaggtcgggtctaggggactgggtacgttccactccgtccgaacccggttcgacgtccgaggtcccgtaggggacgtcccgttggtaacgttgggttaactttttcgggacctttaacggtttttacctttcgttacggttcgaacggtcgtacggttcccggttacccgcccgtaccggtcccgtaccgttccgttaaccgggtttcccgggggccgggggtacccgtagggggttacgggaggtaacggttacgggaaacggtaccggtaacgttcgggtacggtccgttacggacctacccgtagttcccgttcgtttaccgtttcccg

SEQ ID NO: 346074 - DNA, 596 bp, Homo sapiens
  misc_feature: GZ8MTXP02FOK61.45.36.D03.1.454.CMB.2.raw
  modified_base (264)..(264): a, c, t, g, unknown or other
  misc_feature (264)..(264): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaanagaaactggccaggctcccgaggctcctcatccatgatgcatcccaacacggggtcccctgggccgtaccccaggaccaggtttcccgtggcccctaggtggggtctggggacaggacgttccactctcacccgtnagcacgcctggacncctgatgtatttgctacgtttacttctgtcagtcacggtccgttccgccgtacgccccgcttaccgtccggtttccggggaccgggggtaaccgtgggggtcggaaggacgtgggaacggaaccggtaacgtcggtgggccgttaggaaccgtaccagttctacgttcctctacgttccccg

SEQ ID NO: 346075 - DNA, 565 bp, Homo sapiens
  misc_feature: GZ8MTXP02HQ2FT.45.36.D03.1.454.CMB.2.raw
  modified_base (391)..(391): a, c, t, g, unknown or other
  misc_feature (391)..(391): n is a, c, g, or t
  modified_base (433)..(433): a, c, t, g, unknown or other
  misc_feature (433)..(433): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctgggccgtcccagaccgtaggttccgtggcctagggtggggtctggggacaggagtttccacgtcctcacccgtnacggtcagccgtggacgcctgattgtatttgctagtttactntgtcagcaggtcgttcccgccgaccgccgcctcgtacgtttcggggccgggggtaccgaggggtcggacgagtggacgacggtaacgtggtcggtctacgccgaccagttcctgtcctttactactttcccg

SEQ ID NO: 346076 - DNA, 533 bp, Homo sapiens
  misc_feature: GZ8MTXP02GP6HW.45.36.D03.1.454.CMB.2.raw
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (471)..(471): a, c, t, g, unknown or other
  misc_feature (471)..(471): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcgggggagcgttgtccagcctgggaggtccctgagactctcctgtgcagcctctggattctccctcagtaactttggttccactcgggtccgccaggttccaggcaggggctggagtgggtgccctnattccgaagntggaagtgagaaggctactcagctccggtgacgggccgcttcaccactctccagacgacaacttaccaagaatcgtccttcttttgactaaatataatagctagagagttagagacacgtntgtctattctgtgcgaggggactagtctagtgaagtcgtggttacgtagtagtatactaaac

SEQ ID NO: 346077 - DNA, 561 bp, Homo sapiens
  misc_feature: GZ8MTXP02HQZZU.45.36.D03.1.454.CMB.2.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtacaacagaacctggccaggctcccaggctcctcatccatgatgacatccaacncgggtcccngggcctccagacgtaggttcccgtggcctaggtcgggtcaggggacaggtnttccacttcncaccgtnaacgcacggcctaggacgtccgtgattgttatttcgcttaacgtttcttctgttccagtctaggtcttcccgccaccgccgctcgtacggttcggggccggggacaggggtcgagacgtgacgacgtaacgtgtacggctgaacctacgcgttctgttcctttacactttcccg

SEQ ID NO: 346078 - DNA, 777 bp, Homo sapiens
  misc_feature: GZ8MTXP02IKIEQ.45.36.D03.1.454.CMB.2.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggganacagcccaccctctcctgcagggccaggtaggagtgtcagtaagtacttaggctggtaaccaacgagaaacctggccaggcctcccaggcctcccnactccaatcgatgtactccaacgtacgggtccccctgggccccgtcccgaaggtacccgtaacgggtttcccggtggtcgacggggttcggggtccgttagggggaacctaggtacggtttccaccgttcctaccgtaaacccggttcgaaaggacgtcccgtagggacgccgttaggtacgtgttaacgtttttcggaacttacggtttttttacctcggttcgttaccggaacggtaccgtacggtaccccggtttcccccgggaacctaccccggggtaccccgtaccgttccccggttaaccggggtttcccggggggacccggggggtaaccggtagggggttaacgggaaggacggttaacgggaacggtaaccgggtaaaccgtttggggacggttccgtacggaaccctaccggtaactttaccggttacgtttacccgttccgtaccctttcccgtttccccggtaacc

SEQ ID NO: 346079 - DNA, 590 bp, Homo sapiens
  misc_feature: GZ8MTXP02FMY2V.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctcccaggctcctcatccatgatgcatcccaaacgacggggtcccctgggcccgtccccagaccgagggtttcccgtggcccagggttcgggtctggggacaggtagttccactctcacccgtcagcacgcctggacgccgtgatgtatttgcttagtttacttcgtgtcagcacgtccgttcccgccgaccgcccgtctccgtaccggtttccggggccgggggtaccgtaggggtacggaggtacgtaggaacggacgtaacgtggtcggcgtacggcgtaacctacgtcgtcgtcttccactttcccg

SEQ ID NO: 346080 - DNA, 564 bp, Homo sapiens
  misc_feature: GZ8MTXP02G7NVB.45.36.D03.1.454.CMB.2.raw
  modified_base (263)..(263): a, c, t, g, unknown or other
  misc_feature (263)..(263): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (499)..(499): a, c, t, g, unknown or other
  misc_feature (499)..(499): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggcctcctcatccatgatgcatacccaacgacgggtcccctgggccgtcccaggacctagggttccgtggcctaggtgggtctggggacaggacgttcactcncgaccgtcagcagcctggancctgntgtatttcgcttagtttactgtgttcagtcacgtcgttcccgcctaccgcccgtcgtccgtacggtttcggggccgggggtaaccgnggggtggacggagtggaacggacgtaacgtcggtgctaggccacgtactcgtgtctcacttcccg

SEQ ID NO: 346081 - DNA, 677 bp, Homo sapiens
  misc_feature: GZ8MTXP02G2SSO.45.36.D03.1.454.CMB.2.raw
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
  modified_base (609)..(609): a, c, t, g, unknown or other
  misc_feature (609)..(609): n is a, c, g, or t
  modified_base (624)..(624): a, c, t, g, unknown or other
  misc_feature (624)..(624): n is a, c, g, or t
  modified_base (643)..(643): a, c, t, g, unknown or other
  misc_feature (643)..(643): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccacctctcctgcagggccaggtaggagtgtacagtaagtacgttaggctaggtaaccaanacgaaacctggaccaggcctacccgaggcctccacactccatcgatcgacacgtaccgaacgacgggttcccctagggcccgtaccgagtaccgtacgggttccggaggccccgtagggtcggtcgtacggggactacggtacgttccacttccgtaccgtaccgtacacggaccgtaacggtcccgtaggggtaacctccgtaggtaacgtttggtttaacttttcggacgttttaacggttttacctcgttgttaccgagtaccgtaccggttcccgttcccgacccgtaccggtcccgtacttaccgggtacgggttccgggggaccggggtaaccgnggggtacgatacggnggaacgtacgagtgacgtnacgaaccgactcgtactcgtactccgtactcccg

SEQ ID NO: 346082 - DNA, 738 bp, Homo sapiens
  misc_feature: GZ8MTXP02G1CSD.45.36.D03.1.454.CMB.2.raw
  modified_base (209)..(209): a, c, t, g, unknown or other
  misc_feature (209)..(209): n is a, c, g, or t
  modified_base (271)..(271): a, c, t, g, unknown or other
  misc_feature (271)..(271): n is a, c, g, or t
tcagacgcgatcgacacgaccggtgctcgatttagctgcgtcacgatctctcttgggggccctggggaggaactgctcagttaggacccagagggaaccatggaagcctcagctcagcttctcttcctcctgctactctggctcccagataccaccggaaaattgtgttgacacagtctccaggcaccctgtctctgtctccagggganacagccaccctctcctgcagggccaggtaggagtgtcagtaagtacttaggctggtaccaanagaaacctggaccaggcctccccgaggcctcctcatccatgatgcactaccaacggtccgtaccgcggtaccctaccgacgtacggtcccggttcggcgacggtgggttcggtcggtacgggacgtgttacgtacctaccgtcctaccggtcctacgacgtcgaccgtcggtaacggctcggtatacgttagtttacgttacgtaccgtttacgtttacctttcggttactacggtaccgtaccggtacccgggtttccccggtacccccgtaccggccccgtacccggtttccggtaacccggttttcccggggggttacccggggggaaccccggggttaaccggggtgggggtaggtaacggttacgggacgggtaacgggtaaaaccccggttagggtttacggggaaccgtttccggtaacgacccggtaacctttaccggttccggtttacgttttacccg

SEQ ID NO: 346083 - DNA, 684 bp, Homo sapiens
  misc_feature: GZ8MTXP02G8O37.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtacttaggctggtaccaacagaaacctggccaggcctcccgaggcctcctcactccatgatgactactacccgaacgacggggtcccctcgggcccgtaccccgaaggtaccgtacggggtttcccggtggacccgtagggttcggggtcgtaggggaacctaggtacgtttccaccgttctaccgtaccgtcgaggcacgtccgtagggactccgtgtattgttattttcgactttagtttacctcgttagccgtagtccgtacggttcccgttcccgaccgtacccgcccgtcgttacccggttaccggggttccgggggaccgggggtaccggtagggggtcgggaacggtaggttacgggaacggtaaccggtaacggttgggcggtacgtcggaaccgacgtacgttcgttcgttcctttacgtacgtttccccg

SEQ ID NO: 346084 - DNA, 593 bp, Homo sapiens
  misc_feature: GZ8MTXP02JAYT7.45.36.D03.1.454.CMB.2.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
  modified_base (384)..(384): a, c, t, g, unknown or other
  misc_feature (384)..(384): n is a, c, g, or t
  modified_base (453)..(453): a, c, t, g, unknown or other
  misc_feature (453)..(453): n is a, c, g, or t
  modified_base (580)..(580): a, c, t, g, unknown or other
  misc_feature (580)..(580): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccttcagtaactttggtttccactgggtccnccaggttccaggcaaggggctggagtgggtggccctnatttccgaagatggaagtgagaaggcctactcagactccgtgaaggccgcttcaccatctccagagacaattccaagaatgtccttctttttgactaaatgaaatagcctgagagttgaggacacgtctgtctntttctgtgccgagggggacatctatgattcgtggttcgtagttagtaatacaaacttactactacctanattggacgttcgtaggggacgaaagggcccgtacggtcaaccggtctcccgcacgccttaccaaccgtaaacgggcccaacgttccggtcccttcccccgcggcccgtcccgtcgcctccgaggacnccgtacctccggg

SEQ ID NO: 346085 - DNA, 590 bp, Homo sapiens
  misc_feature: GZ8MTXP02HTJUD.45.36.D03.1.454.CMB.2.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtacttaggctgacanagaacngcagcnccagctcctcatccatgatgcatccaacgcgggtccctgggccgtcccagaccgtaggttccgtggccctaggtggggtctggggacacggtagttccgactctaccgaccggttcacgccacgccctaggacgtcctgattgttattttggacttaagttttcttcgtagtcagtctacggtcccgttccgcccgtaccgccgtctccgtacggtttcgggggacggggtccgaggggtcggacgtagtggaacgaccggtaacgtcggtggcacggaaccaaccgttcgttcgttcgttccttacgtaccttcccg

SEQ ID NO: 346086 - DNA, 578 bp, Homo sapiens
  misc_feature: GZ8MTXP02HG7C2.45.36.D03.1.454.CMB.2.raw
  modified_base (474)..(474): a, c, t, g, unknown or other
  misc_feature (474)..(474): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
  modified_base (576)..(577): a, c, t, g, unknown or other
  misc_feature (576)..(577): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcgagggccaggtaggagtgtcaacgaggttccgtggcaggtgggtctggggacagagttcactctcaccgtcagcagcctggacgcctgatgattttgctagtttactctgtcagcagccgttccgccacgccgctcgacgtttcgggggcgggggctaggggtcgagtcgtagagaccgtaagtggtggctgacacgtatcgttcgtccttcgacttcccgttccccactacgttcgtacgtacttccgggntttcccggcgtttaccgtaggggaccggcccgggggtacttccgggggacgaaaaccgggggccggtaccgaaaattcgggcgcgngngngcgcgcngcgcnng

SEQ ID NO: 346087 - DNA, 608 bp, Homo sapiens
  misc_feature: GZ8MTXP02G87S1.45.36.D03.1.454.CMB.2.raw
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctcccagataccaccggaaaattgtgttgacacagtctccaggcaccctgtctctgtctccgaggggagacagccaccctctcctgcgagggccaggtaggagtgtcagtaagtactaggctggtaccaanagaaaccnggccaggcctcccaggcctcctcatccatgatgcaatcccaacgcgggtccctggccgtcccagactagggttccgtggcccgtaggtggggtcgaggggacaggtagttccactctccgaccgtcagcacgcctaggactcctggactgtattttggacttagtttactcgtagtcagtccacggtccgttacccgccaccgtcccgtactccgtaccgggttccgggggaccgggggtaccgtagggggtcggaacggaggtagggaacggtaacggtaacgtgggtcgtcgtacgaaccgacctagttccgtgttaccttcgtactttccccg

SEQ ID NO: 346088 - DNA, 532 bp, Homo sapiens
  misc_feature: GZ8MTXP02GNKOD.45.36.D03.1.454.CMB.2.raw
  modified_base (311)..(311): a, c, t, g, unknown or other
  misc_feature (311)..(311): n is a, c, g, or t
  modified_base (426)..(426): a, c, t, g, unknown or other
  misc_feature (426)..(426): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacngggtcccctgggccgtcccagacgtaggttccgtggcctaggtggtctggggacagtgttcactctcaccgtcagcagcctgagcgtgatgtatttgctagtttacttcgtgtcngcacgtcgttccgccaccgtccgctcgtacggttcggcgggggacgagggtcggagagtgacgacgaacgtcgcgctcgcaccgtatcgtgtccttcactttcccg

SEQ ID NO: 346089 - DNA, 710 bp, Homo sapiens
  misc_feature: GZ8MTXP02HJZF0.45.36.D03.1.454.CMB.2.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (644)..(644): a, c, t, g, unknown or other
  misc_feature (644)..(644): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacacgcccaccctctcctgccagggccaggtaggagtgtcagtaagtacttaggctggtaaccaanacgaaacctggaccaggcctacccgaggcctcctcatccatgatgcactaccaacgacggggtcccctgggccctcccgaaggaccgtacgggtttcccggtggacccgtacggggttggggtacgtaggggacctagggtaacgtttccaacgtcctaccgacccggttacaacggcccacgtcccgttagggaccgtcccgttggtatttagttaagtttttcgggacctttaaacggtttttaccttccgttggttacccaaggtccgttacgggttccccgttccccggacccgtacccgtcccggttccgttaccggtacccgggtttccgggggaccggggggtacccgtagggggttcggaacgtacggngggaaacggacgaaacggttgggtcggaccgtgaacctaccgtatccgtgtcctaacgtcttcccg

SEQ ID NO: 346090 - DNA, 579 bp, Homo sapiens
  misc_feature: GZ8MTXP02I219Q.45.36.D03.1.454.CMB.2.raw
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (417)..(417): a, c, t, g, unknown or other
  misc_feature (417)..(417): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctgccaggctcccaggctccncatccatgatgcatccaacaggtccctggcctccagactaggtccgtgccgaggtcggtctgggacaggagttcactctcgaccgtcacggcagcccgtggacgcctgatgtatttgctagtttactntgtcagctagtccgttcccgcctaccgcccgtcctcgtaccggtttccggggacgggggtacccgtagggggtcggacgtaggtcggaacggtaacgtaacggtcgtcggtacgtcggaaccaaccggtacttccgtacggttcctttacaccgtttccccg

SEQ ID NO: 346091 - DNA, 547 bp, Homo sapiens
  misc_feature: GZ8MTXP02IVESQ.45.36.D03.1.454.CMB.2.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
  modified_base (383)..(383): a, c, t, g, unknown or other
  misc_feature (383)..(383): n is a, c, g, or t
  modified_base (432)..(432): a, c, t, g, unknown or other
  misc_feature (432)..(432): n is a, c, g, or t
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
  modified_base (534)..(534): a, c, t, g, unknown or other
  misc_feature (534)..(534): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccgagggganacagcccaccctctcctgcagggccagtaggagtgtcagtaagtacttaggctggtaaccaanagaaacctggccaggcnccagctccnatccatgatgcatcccaagcgggtcccngggcctcccagacaggttccgnggccaggtggtctgggacagacgttcactcgtccgccgtnaacgcagccgtggacgcctggactgtattttgctagtttactctgtacngcagtcgttccgccgacgcccgntcctacggttcggggccgggggaccgnggggtacgagagtggacggtaacgaacgtcgtaggctgaaccacgactcgtntaccttctactcc

SEQ ID NO: 346092 - DNA, 605 bp, Homo sapiens
  misc_feature: GZ8MTXP02GN0OM.45.36.D03.1.454.CMB.2.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtcttaggctggtaccaanagaaacctggccaggcctcccaggctcctcactccatgatgcatcccaaacgcggggtcccctgggccgtacccgaggacctacggggttcccgtggccccgtagggttggggtctaggggaccaggtacgttccacttcgtaccgaccgtcaacgcgacgccgtggacgcctagattgtattttcgcgttacgtttacttctcgtatacgtctacggtccgttccgcccacgccccgtcttccgtaccggtttccggggccgggggtacctagggggtcggagtaggtacggaacggtaacgacgttggcgcgtgctaccgatcgtgtctctacgtttccc

SEQ ID NO: 346093 - DNA, 625 bp, Homo sapiens
  misc_feature: GZ8MTXP02GGQAV.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtacttaggctggtaccaanagaaacctggccaggctcccaggctcctcatccatgatgcactccaaacgacggggtcccctgggcccgtccccgaaggaccgtacggggttcccgtggccccgtagggtcggggtctgggggaacaggtagttccacgtctaccgaccgtcagcagccgtggacgcctgatgtatttgcttagtttacttcgtgtcaggtctacggtccgttcccgccgtaccgcccgtacgtccgtaccggtttccgggggccgggggtaccgagggggtcggaacggtagtaggaacggtaaccggtaacgtgggtacgggccgtcggaacctaccgtagttcgtacggttccttcgtactttccccg

SEQ ID NO: 346094 - DNA, 552 bp, Homo sapiens
  misc_feature: GZ8MTXP02FMVEE.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcncatccatgatgcatccaacagggtcccctgggcgtcccagaccaggttcccgnggcccaggtgggctggggacagattcactctcaccgtnagcagcctganctgatgtatttgctagtttctctgtcagcagccgttccgcctacgcccgctccgtacgtttccggggcgggggtaccgtagggggtcggacggtagtcggaaggtaccgtaaacgtggtcggctggcctaaccgtactcgttgttaccttacactttcccg

SEQ ID NO: 346095 - DNA, 596 bp, Homo sapiens
  misc_feature: GZ8MTXP02JZALA.45.36.D03.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccaggtaggagtgtcagtaagtacttaggctggtaccaanagaaacctggccaggcctcccaggcctcctcatccatgatgcatccaagcgggtccctggcctccagacctaggttccgtggccctagggtcgggtcgtaggggacaggtacgttcgactctccgaccgtcacgcagcccgtggacgcctgactgtatttgcttaagtttcttcgttgtacagctacggtccgttccgacccgaccgtcccgtccgttaccgtaccgggtttccggggaccgggggtaccgtagggggtcggagtacgtggaacggacggtaacgttggcggtcgcggaaccacgtactccgttcgtccttcactttccccg

SEQ ID NO: 346096 - DNA, 672 bp, Homo sapiens
  misc_feature: GZ8MTXP02JA1SR.45.36.D03.1.454.CMB.2.raw
  modified_base (211)..(211): a, c, t, g, unknown or other
  misc_feature (211)..(211): n is a, c, g, or t
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcgagggccagtaggagtgtcagtaagtacgttaggctggtaccaacgagaaacctggccaggcctacccgaggcctcctacatccatgatgcatccaacgcgggtccctggcctccagacgtacggttccccgnggcctaggtcggggtcgtaggggactggtacgttcacttccgtaccgtaacccggtnaacggccacgtcccgtagggaccgtccgtgaactttcgttaatttttcggactttaggttttacttcgttcggtactacgtcgtaccgtccggttaccccgccgtaccggtcccgtaccgttccgttaccgggtttccgggggaccgggggtaaccgtacgggggtacgggtaagagggttaacggaacgggtaaccgtaaaccggttggacggcgtacgaccgtaccgtagttccgttacgttacctacg

SEQ ID NO: 346097 - DNA, 617 bp, Homo sapiens
  misc_feature: GZ8MTXP02GVOPU.45.36.D03.1.454.CMB.2.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctgccaggctccagctcctcatccatgatgacatccaacgacgggtccctggcctcccagacgtggttccccgtggcctaggtcggggtctggggacaggtacgttcaacgtcctacgaccgtcacgcacgtccgtggacgccgtagtacgtgtattttcggacttacgtttactttcgttgttcgtacgtcgtacgtccggtttcccgcccgtaccgcccgtccgttccgtaccggtttccggggaccggggggtaccgtagggggtacgggaggtacgtaggaacggacgaacgtggtacggcgtcggaccgtaccgtactccgtacggttctttccg

SEQ ID NO: 346098 - DNA, 578 bp, Homo sapiens
  misc_feature: GZ8MTXP02I1SD9.45.36.D03.1.454.CMB.2.raw
  modified_base (288)..(288): a, c, t, g, unknown or other
  misc_feature (288)..(288): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtactaggctggtaccaacagaaacctggccagctccaggctccncatccatgatgcatccaacagggtcccctgggcgtcccagacaggttccgtggcccagtggggtctgggacagagttcactctcaccgtcagcacgcctgaacctgactggtattttggcctaagttttacttcgtgtacacgtcacggtccgtttcccgcccgtaccgcccggtccttaccgtaccgttttcgggggaccggggggtcccgtagggggtggaggacgtggaacgacggtaacgtggtcggctggacaactacgtcttcgtctttcacgttccttacccg

SEQ ID NO: 346099 - DNA, 714 bp, Homo sapiens
  misc_feature: GZ8MTXP02H91II.45.36.D03.1.454.CMB.2.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctgccaggcctccaggctcctcatccatgatgcatccaanacgggtccctgggcctccagaacctagggttccgtggccccaggtcggggtctaggggactaggtacgttcaccgttctccgaacccgttcaacggccaacggtcccgtagggacgtcccgtaggtagtgggtttaactttttcgggactttaacggttttaaccctttcgtggttacccgtaaggtcccgtaagggttccccggtttccccgacccggtacccggtccccggtcccttccgttacccggggtttccgggggacccggggggacccgtaagggggttcgggaaggtacggttacggggaaacgggtaaaccggtaaaccggtttgggaccgggtcgttcccgggaaccgtacctaacgtttcgtacggtttccctttaactcccgttttcccccgg

SEQ ID NO: 346100 - DNA, 601 bp, Homo sapiens
  misc_feature: GZ8MTXP02GVVCK.45.36.D03.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaanagaaacctggccaggcctccgaggcctccncactccatgatgcactaccaacgtacgggtcccctggccgtacccagactacgggttccggtgaccgtaggtcgggtctggggacaggttacgttcgacctcgtaccgaccgtcgaacgtcacggtcccgtaggacgtccgtagtactgttatttgactttacggtttactcgtagtcagtctacgtccgtcccgccgacgccgtctacggtacgttcgggggaccggggtagaggggtgaacgtgtaggacgtaacgtacggtgtacggctaggaaccactacgtcttacgtcttacgtcttccccg

SEQ ID NO: 346101 - DNA, 525 bp, Homo sapiens
  misc_feature: GZ8MTXP02FJQ8T.45.36.D03.1.454.CMB.2.raw
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
  modified_base (467)..(467): a, c, t, g, unknown or other
  misc_feature (467)..(467): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaaacngggtccctggccgtcccagacaggttccgtggccagtgggctggggacagagttcactctcaccgtnagcagcctggagcctgatgtatttgactagtttacttctgttcagcagcgttcccgccacgcccgctcacgtttcgggcgggggaccgnggggtcggagagtggacgacgaacgtggtagctgcgacctatcctgtctacattcccg

SEQ ID NO: 346102 - DNA, 616 bp, Homo sapiens
  misc_feature: GZ8MTXP02JF77H.45.36.D03.1.454.CMB.2.raw
  modified_base (262)..(262): a, c, t, g, unknown or other
  misc_feature (262)..(262): n is a, c, g, or t
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctcccaggctcctcatccatgatgcatccaacgagggtcccctagggcctcccaggaccgtacggtttccgtggcccgtaggtcggggtctaggggacaggtacttccgactctccgacccgtnacgctacgccgtgganccctagacttgtattttcgcttagtttactcgtgtacagcgtagtccgttacccgccgaccgtcccgtccttaccgtaccggtttccgggggcccgggggtaaccgtacgggggtacggaggacgtggaaacggtaccgaaacgttggtacggccgttagccgtaaacctacgtccgtgttccttacctactttccccg

SEQ ID NO: 346103 - DNA, 578 bp, Homo sapiens
  misc_feature: GZ8MTXP02J2MLF.45.36.D03.1.454.CMB.2.raw
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaacggaaaaattgtgttgacacagtctccaggcaccctgtctctgtctccagggganacagccacctctcctgcagggccagtaggagtgtcagtaagtcttaggctggtaccaanagaaacctggccaggctcccaggctcctnatccatgatgcatccaacngggtcccnggcctcccagcgaggttccccgnggcaggtggtctggggacnggagttcactctacgaccgtnacgcacgccgtggacgtctgacttgtagtttcgacttagtttacttctgtcagctagtccgttccgacctccggcctccgtcgtacggtttccggggaccgggggacctagggggtacggacgtaggtacggacggacgtaaccgttggacgggctacggacctaaccgtagtccgttcgttcctttacg

SEQ ID NO: 346104 - DNA, 546 bp, Homo sapiens
  misc_feature: GZ8MTXP02F6EDH.45.36.D03.1.454.CMB.2.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (499)..(499): a, c, t, g, unknown or other
  misc_feature (499)..(499): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtactaggctggtaccaanagaaacctggccaggctcccaggctcctcatccatgatgcatcccaacacgggtccctgggcctcccgagaccgaggttcccgtggcctaggtcgggtctggggacagacgttcactctcaccgtnaagcctagctggagcctagntgtatttgactagtttactcgtgtccaggtcacgtcgttcccaccgtaccgcccgcttcgacggtttcgggcgggggaccaggggtcggagngtgaacgacgtaagcgtaggcagcacgctcncgttctacnctttccc

SEQ ID NO: 346105 - DNA, 725 bp, Homo sapiens
  misc_feature: GZ8MTXP02HSU9Y.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctccagataccaccggaaaattgtgttgacacagtctccaggcaccctgtctctgtctccgagggganacacgccaccctctcctgcgagggccaggtaggagtgtcaagtaagttacgttaggctacggtaaccaaacgaaggaaaccctggacccaggcctacccgaggcctccgtcactcccatcgatcgacactaccgaaacgtacggggtcccctgggcccgtacccgaggaccgtaggggttcccgaggcccgtacgggttcggggtcgtacggggaacaggtacgtttccacgttcctaccgaccggtcacggccacggtccgtaggggacgtcccgtagacgttgttacgtttttcggacttacggttttaccttcgttcgtacgtacgtccggtacgggttcccgttccccggacccgtaccggtcccgtccgttacccgttaccgggtttccgggggaccggggggtaaccggtagggggttacgggacggacgtacggggacggttaccggaaacggttcgggtcggtacgttcgggaacctaaccgtacgttcgtcggtttccttactaccgtttccccg

SEQ ID NO: 346106 - DNA, 570 bp, Homo sapiens
  misc_feature: GZ8MTXP02I7HQ6.45.36.D03.1.454.CMB.2.raw
  modified_base (551)..(551): a, c, t, g, unknown or other
  misc_feature (551)..(551): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggcctcctcatccatgatgcatcccaaacgacgggttcccctgggccgtccccaggacctagggttccgtggcccaggtggggtctggggacaggtacgttcactctcaccgtcaggcagcctggacgcctgatgtatttgctagtttactctgttcagtcacggtccgttcccgccaccgcccgctacgtacggtttcggggccgggggtaccgaggggtcggacgtaggtcgacggaacggtaacgtcggtgcgtagccaaccgtntcgtgtccttctacttccg

SEQ ID NO: 346107 - DNA, 693 bp, Homo sapiens
  misc_feature: GZ8MTXP02IRQ40.45.36.D03.1.454.CMB.2.raw
  modified_base (266)..(266): a, c, t, g, unknown or other
  misc_feature (266)..(266): n is a, c, g, or t
  modified_base (296)..(296): a, c, t, g, unknown or other
  misc_feature (296)..(296): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccaggtaggagtgtcaagtaagtacttaggctggtaaccaanagaaacctggccaggcctccgaggcctccncatccatgatcgcatccaacgcgggtcccctgggccgtccagactagggttccgtggccctaggtcgggtctggggactaggtcgttccacttccgtccgaacccggttcacggacctacggcccgttggaaccgtccgtagagttaggtatttttcggacttaggttttaccttcgtcggttacgtaacggtccgtaacggttcccggtttaccccgcccgtaaccccggtccccggtccttaccggtaaccgggtttccgggggcccgggggttaacccggagggggttacgggaacggtacgttaggggaacgtaaaccggtaacgttgggtacggtccgttcggaacctaccgtacgtttccgttacggttcctttccgtacgttttcccccg

SEQ ID NO: 346108 - DNA, 686 bp, Homo sapiens
  misc_feature: GZ8MTXP02HK8T1.45.36.D03.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtcctccgaggggagacagcccaccctctcctgccagggccaggtaggagtgtcagtaagtacttaggctggtaccaanagaacctggccagctcccagcctccnatccatgatgcatccaacgcgggtccctgggcctcccaggaccgtggttccgnggcccgtaggtcgggtctaggggacagtacgttcacttcacctaccggtcaacgcctacgcccgtagggacgtcccgtaggtacgttagttagtttttcgacgtttaacggttttaccttcgttcgttaccgaacgtccgtaacggttcccgtttacccgccccgaacccggtccccggtaccttcccggttaccgggtttccgggggccggggggtaacccggtagggggttacgggaacgggtagggtacggaacggtaacggtaaccggttcgggcggtacgttcgaaccgtaccgtaacttccgttagttacccttccgtttaccgtttccccg

SEQ ID NO: 346109 - DNA, 642 bp, Homo sapiens
  misc_feature: GZ8MTXP02I1UZ4.45.36.D03.1.454.CMB.2.raw
  modified_base (264)..(264): a, c, t, g, unknown or other
  misc_feature (264)..(264): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtacttaggctggtaaccaanagaaacctggccaggcctcccaggcctccncatccatgatgcactccaagtcgggtccctggccgtcccagtacgtacggttccgnggcccgtaggtgggtcgtcggggacaggtacgttccacttccgtccgtacccgtcaacgggcctacggcccgttaggggacgtccgtaggattgttacttttcggactttacggttttacctcgtgtactacggtcctacggtccgttacccgccgtaccgcccgtctaccgtaccgggtttccgggggaccgggggtacgtagggggtcgtaaggagttacgggaacggtacggacgttcgggtcggctcggaaccgaccgtagttccgtcgttccttacgacctttcccg

SEQ ID NO: 346110 - DNA, 609 bp, Homo sapiens
  misc_feature: GZ8MTXP02G7HFE.45.36.D03.1.454.CMB.2.raw
  modified_base (434)..(434): a, c, t, g, unknown or other
  misc_feature (434)..(434): n is a, c, g, or t
  modified_base (590)..(590): a, c, t, g, unknown or other
  misc_feature (590)..(590): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggcctcctcatccatgatgcatccaacgacgggtccctggcccgtacccagactaggttccccgtggcaggttcggggtactggggactagggacgtttcaccttccgtccgaaccgttcacggcacgcccgttgggaacncccgtagattggtacttttggaccttagtttaccttcgtgtctacgcgagtcccgttaccggcccaccgtcccgtctcgtaccggtttccgggggaccgggggtaccagggggtcgaaggcgtggaacgtaccgacgtggtggcgtgaccaccgtntcgtacgttactttaaccg

SEQ ID NO: 346111 - DNA, 594 bp, Homo sapiens
  misc_feature: GZ8MTXP02JBGCL.45.36.D03.1.454.CMB.2.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtcttaggctggtaccaacagaaacctggccaggctcccagactcctcatccatgatcgcatacccaaacgcggggtcccctgggcctccccaggaccagggttcccgtggcccctagggtcgggtctggggactagagttcactctccaccgtnaggcacgcctggacgtcctgattgtatttgacttacgttttactctgtcagtctacgtccgttcccgccgaccgcccgtcgtaccgtacggtttaccggggcggggggtaccagggggtcgaacggagttacgggacgacggtaacgtggtcggctggaaccaccgtagttcctcgttccttacgtactttcccccg

SEQ ID NO: 346112 - DNA, 739 bp, Homo sapiens
  misc_feature: GZ8MTXP02I23D3.45.36.D03.1.454.CMB.2.raw
  modified_base (291)..(291): a, c, t, g, unknown or other
  misc_feature (291)..(291): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtactaggctggtaccaacagaaacctggccaggctcccaggcctccncatccatgatgcactacccaacgtcggggtcccctgggcctacccgaagaccgtacgggttcccgtggccccgtagggtcggggtcgtaggggacaggtacgtttccaccgttcctaccgacccgttcaacggccacggtcccgtaggggaccgtcccgtaggtacgttgttagtttttcggacgtttaacggtttttaccctttcgttcggttaccgtaacggtccgtaccggttcccggtttccccggaccccgtaacccggccccgtccgttcccgttacccgggttttcccgggggacccggggggttaacccgacgggggttacggaacgggtacgttaggggaaccggtaaaccggtaaacggttcgggttacgggtccgttcggtaacccgaacccgttaacgttcccgttcggtttaccctttccgttaacctttccccg

SEQ ID NO: 346113 - DNA, 611 bp, Homo sapiens
  misc_feature: GZ8MTXP02GVHKW.45.36.D03.1.454.CMB.2.raw
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
tcagacgcgatcgacacgaccggtgctcgatttagctgcgtcacgatctctcttgggggaggaactgctcagttaggacccagagggaaccatggaagccccatctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctccaggctcctcatccatgatgcatccaacngggtcccctggccgtcccagaccaggttccggnggccgtaggtggtcgtgggacaggtacgttccactctccgaccgtcagcacgccgtggacgtccgtagattgttatttcggtacttaacgttttacttcgtacgtacctagtcgtacggttccgtcccgcccgtaccgtcccgtcttaccgtaccggtttccgggggaccgggggtaccgaggggtggaacgtaggtagaacggaacgtacgttcggacggtcctaggaacctacgtacgttcctacgttaccttacgtactttcccg

SEQ ID NO: 346114 - DNA, 643 bp, Homo sapiens
  misc_feature: GZ8MTXP02GUUMS.45.36.D03.1.454.CMB.2.raw
  modified_base (311)..(311): a, c, t, g, unknown or other
  misc_feature (311)..(311): n is a, c, g, or t
  modified_base (448)..(448): a, c, t, g, unknown or other
  misc_feature (448)..(448): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacttggccaggctcccaggctcctcatccatgatgcatccaacgngggtcccctgggccgtcccagacctaggttccgtggcccaggtggggtctggggaacaggtacgttccacttctaccaccgtcagcacgcccgtggacgctgatgttatttcgcttacgttttactcgtcgttacgngtcctacggtccgttcccgccgtaccgtcccgtaccttccggttaaccgggtttccggggggaccggggggtaaccgtacggggggttagggaacggtaggtacgggaaacgggtaaccggtaacggttcgggtcggcgttacggaacctaacccggtattccgtacggtttcccttacgtaccgttttcccccg

SEQ ID NO: 346115 - DNA, 716 bp, Homo sapiens
  misc_feature: GZ8MTXP02HZZMS.45.36.D03.1.454.CMB.2.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccgagggganacagccaccctctcctgcagggccagtaggagtgtcaagtaagtacttaggctaggtaccaanagaacctggaccaggcctcccaggctcctcatccatcgatcgacactaccaacgtacggggtcccctagggccgttacccaggtaaccgtaggggtttccccggnggacccgtaggggttcggggtacgtacggggaactaggtacgtttcccaccttccgtacccgaccgtaccacggaccgtacgacccgtacgggacgtaccgtagtacgttagtttacgtttacgtacgtttaacgtttactttcgttacgtacgtacggtacgtacggttacccgttcccgacccgtacccgtccgtaccgttaccggtaccggggtttccgggggaccgggggtaccggtacggggtacggtacggtacgtacgggaacggtaaacggtacggtacggtcggtacgtacgaaccgtaaccgtacgttcgttcgtttaccgttcgttaccgttcccg

SEQ ID NO: 346116 - DNA, 590 bp, Homo sapiens
  misc_feature: GZ8MTXP02JY7GI.45.36.D03.1.454.CMB.2.raw
  modified_base (201)..(201): a, c, t, g, unknown or other
  misc_feature (201)..(201): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcagggccaggtaggagtgtcagtaagtacttaggctggtaccaacagaaacctggccaggctcccaggcctctcatcccatgatgcatcccaacgcgggtccccnggccgtcccagacgacggttccgnggcccaggtggggtcctggggactaggattccactctccaccgtcacgcacgcctggacgtcctgatgtatttgacttagtttctgtgtcagtcagtccgttccgccaccggccgtcctaccgtaccggtttccgggggccggggggtaccgtagggggtcggaacggtagtagggacgtaacggacgtgggtacgccgtcggaaccaacccgtgttccgtgttccttaccacgtttccccg

SEQ ID NO: 346117 - DNA, 574 bp, Homo sapiens
  misc_feature: GZ8MTXP02H0P8G.45.36.D03.1.454.CMB.2.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (461)..(461): a, c, t, g, unknown or other
  misc_feature (461)..(461): n is a, c, g, or t
  modified_base (548)..(548): a, c, t, g, unknown or other
  misc_feature (548)..(548): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccagggganacagccaccctctcctgcagggccagtaggagtgtcagtaagtacttaggctggtaccaanagaaacctggccaggctcccaggctcctnatccatgatgcatccaacgngggtccccnggcctacccagacgtaggtccgnggccgaggtcggggtctaggggactaggtcttcgactctaccgaccgtcgacgacacgtccgtggacgcctgatgttattttgcttagtttacttctgtacctagctacgtccgtcccnccgaccgccgccgtaccgtaccggttcggggccgggggaccagggggtcgacggagtacggacgacgtaacgtgtacgcgtgaaccncgtactcgtctccttacacgttcccg

SEQ ID NO: 346118 - DNA, 537 bp, Homo sapiens
  misc_feature: GZ8MTXP02GOB1G.45.36.D03.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtcctctgtctccagggganacagccaccctctcctgcagggccagtaggagtgtcagtaagtcttaggctggtaccaanagaaacctggccaggctcccgaggcctcctcatccatgatgcatccaanagggtccccnggcctcccagactaggtcccgtggccaggtggtcnggggacngagttcactctcaccgtnagcagcctgacnctgatgtatttgcttagttactctgtcagcagtcgtccgccacgccgctctacgttcgggcgggggtaccgaggggtcgagtagtacggagacgtaacgtggtcggctcggaaccaccgtattccgtgttccttcgtacttccc

SEQ ID NO: 346119 - DNA, 724 bp, Homo sapiens
  misc_feature: GZ8MTXP02I13U8.45.36.D03.1.454.CMB.2.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcagggccaggtaggagtgtcagtaagtacttaggctggtaccaanagaaacctggccaggcctcccgaggcctcctcatccatgatcgacatacccaagacggggtcccctgggccgtcccaaggaccgtaggggttcccgtggcccgtagggttcggggtcctgggggaactaggtacgtttccgaccttccgtaccgaacccgttcgaacgtaccgaacggtcccgttaggggaaccgtcccgttaggtaaacgtttcggttaagtttttcggaccgtttaacggtttttacccttcgttcggttaccgaacggttccgtacggttcccgttcccccgccgtacccgccccgtcgttaccgtacccgggtttccgggggaccggggggtaccgtagggggtacggtaacggtacggtacgggaacggtaaacggtaacggtttgggcggtcttacggcctaaaccgtagtttccggtctttccgttacctacgtttccccg

SEQ ID NO: 346120 - DNA, 597 bp, Homo sapiens
  misc_feature: GZ8MTXP02ILCRY.45.36.D03.1.454.CMB.2.raw
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (407)..(407): a, c, t, g, unknown or other
  misc_feature (407)..(407): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctccagctccnatccatgatgcatccaacgacgggtcccctggccgtacccagaccagggttccgtggcctaggtcggtcgtggggacaggtacgttcactctccgaccgtcagcagcctggacgcctgntgtatttcgacttagtttacttcgtgttacacgtcgtacgtccgttcccgccgtaccgcccgtcgtccgtacggtttccgggggccggggggtaccgtagggggtcggtacggtagtaggaacggtaacggtaacgtcggtacggtcgtacggccaccgtacgttcgtacgttccttacgtactttcccg

SEQ ID NO: 346121 - DNA, 562 bp, Homo sapiens
  misc_feature: GZ8MTXP02I8H3P.45.36.D03.1.454.CMB.2.raw
  modified_base (262)..(262): a, c, t, g, unknown or other
  misc_feature (262)..(262): n is a, c, g, or t
  modified_base (499)..(499): a, c, t, g, unknown or other
  misc_feature (499)..(499): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaactggccaggctcccgaggctcctcatccatgatgcatccaagcgggtcccctgggcctcccagaccaggttccgtggcccgtaggtggggtctggggacaggtacgttccgacttctccgaccgttcacgcagcccgtggacgccgtgattgtatttgcttagtttactctgttcagcacgtccgttcccgccgaccgccgcgtcgtaccgtttcggggccgggggtaccgnggggtcggaggagtggacgaacgacgtcggtcggctggctacctatcgtgtcttcacttcccg

SEQ ID NO: 346122 - DNA, 681 bp, Homo sapiens
  misc_feature: GZ8MTXP02GSODH.45.36.D03.1.454.CMB.2.raw
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (376)..(376): a, c, t, g, unknown or other
  misc_feature (376)..(376): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccnccaggttccaggcaaggggctggagtgggtgccctnatttccgaagatggaagtgagaaggcctactcagactccgtgaaggccgcttcaccatctccagagacaattccaagaatgtccttcttttgcaaatgaatagcctgagagtgagacagtctgtctnttctgtgccgtagggggacagtctaatgacgttcgtgggtttcgtaagttgtaaacttactaaacttactaccttacctataactcgggtaacgttcgttcgggggacgaaaacgggggtaccctaccggggttaccaaccggtcccgtccccggctacgggtaccctttaccccgaacccgaaaaccggggcccccaaacggttcccgggttcccctttacccccccgttcgggggcccctcccccgttacgggcccctttacccggaacggggtaaccgccccgtaaccccgtttcccggggg

SEQ ID NO: 346123 - DNA, 569 bp, Homo sapiens
  misc_feature: GZ8MTXP02GB334.45.36.D03.1.454.CMB.2.raw
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (393)..(393): a, c, t, g, unknown or other
  misc_feature (393)..(393): n is a, c, g, or t
  modified_base (549)..(549): a, c, t, g, unknown or other
  misc_feature (549)..(549): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccagtaggagtgtcagtaagtcttaggctggtaccaacagaaacctggccaggcctcccgaggcctcctcatccatgatgcatcccaaagcgggtccccnggccgtcccagacnggttccgnggcctaggtcgggtctggggacaggtacgttcacttcgtcacccgtnaagccagccgtggacgcctagatgtatttgactagtttactctgtcagcacggtcgttccgaccacgccgtctcgtacgttcgggcgggggacctaggggtcggaggagtggaacgacggtaacgtgtacggctacggccaccgtacgttcccgtnttccgacttaccctttcccg

SEQ ID NO: 346124 - DNA, 694 bp, Homo sapiens
  misc_feature: GZ8MTXP02JGQP4.45.36.D03.1.454.CMB.2.raw
  modified_base (211)..(211): a, c, t, g, unknown or other
  misc_feature (211)..(211): n is a, c, g, or t
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgccaccctctcctggtaggccaggtaggagtgtcagtaagtacttaggctggtaccaanagaaacctggccaggctcccaggcctccnatccatgatcgcatacccgaaacgtacggggtcccctgggacccgtaccccaaggtaccgtacggggtttccgtacgggcctagggttcggggtacgtggggaacctagggtacgtttccaacgttccgtacgacccgtcacgtccgacgtccgtaggacgtccgtaggtaagttgttacttttcggacgttagttttaccttcgttaggtacgacgtacgtacggtcccgttcccggacctaccggtcccgtccgttaccgtaccggtttccgggggaccggggggtaccgtagggggttacggaacggtacggtaggaacggtaaaccggtacgttacgggtacggcgtaacggcctaaccgtagttcctacggttcctttacgtaccg

SEQ ID NO: 346125 - DNA, 544 bp, Homo sapiens
  misc_feature: GZ8MTXP02I20S0.45.36.D03.1.454.CMB.2.raw
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (525)..(525): a, c, t, g, unknown or other
  misc_feature (525)..(525): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctccctgcagggccagtaggagtgtcagtaagtcttaggctggtaccaanagaaacctggccaggcctcccaggctccctnatccatgatgcatccaacgagggtcccctggccgtcccagacgaggttccgnggccaggtgggtctggggacagagttcactctcaccgtcagcagcctgacgctgatgattttgcttagtttacctgtgtcagctaggccgttcccgcaccgccgtctaccgtcgtttcggggccgggggactagggggtgacggagtggacggtaacgaagtcggtaggctgcgaacctntctcgtcttcgtacttccg

SEQ ID NO: 346126 - DNA, 545 bp, Homo sapiens
  misc_feature: GZ8MTXP02GYN9C.45.36.D03.1.454.CMB.2.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (393)..(393): a, c, t, g, unknown or other
  misc_feature (393)..(393): n is a, c, g, or t
  modified_base (471)..(471): a, c, t, g, unknown or other
  misc_feature (471)..(471): n is a, c, g, or t
  modified_base (527)..(527): a, c, t, g, unknown or other
  misc_feature (527)..(527): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtagagtgtcagtaagtactaggctggtaccaanagaaacctggccagctccagctcctcatccatgatgcatccaacacgggtccctggccgtcccagacacggttccgtggccgagtggtctaggggacaggagttcgactctccaccgtcagcacgccgtagcnctgatgtatttgctagttactctgtccagtcacgtcttaccgccgacgccgcctcgacgtttcggggccgggggtacncgggggtagacggtacgtgacgacgaacgtcgacggtctacgcgaccctaagttcngtttccctcactttcccg

SEQ ID NO: 346127 - DNA, 576 bp, Homo sapiens
  misc_feature: GZ8MTXP02IWHVJ.45.36.D03.1.454.CMB.2.raw
  modified_base (263)..(263): a, c, t, g, unknown or other
  misc_feature (263)..(263): n is a, c, g, or t
  modified_base (287)..(287): a, c, t, g, unknown or other
  misc_feature (287)..(287): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaccaanagaaactgccaggctccagctccnatccatgatgcatcccaagtcgggtcccctggccgtccagaccgtacggttccgtggccctagggtcgggtctaggggacaggtacgttccacgtctaccacccgtcagcacgcccgtaggacgcctagagttgtattttcgacttaagtttaccttgtgttaccagtccgacggttccgttcccgcgtaccgcccgtctccgtacgttcgggggaccggggtacgaggggtcgagtgtaggacgacgacgtggaggctgaacaccgtntcgngtcctacgcgttcccg

SEQ ID NO: 346128 - DNA, 691 bp, Homo sapiens
  misc_feature: GZ8MTXP02IXFBZ.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (357)..(357): a, c, t, g, unknown or other
  misc_feature (357)..(357): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccaggtaggagtgtcagtaagtacttaggctggtaccaanagaaacctggaccaggcctcccgaggcctcctcactccatgatcgcatcccaacgacgggtccctcgggcctcccaggacctagggttcccgnggcctagggtcggggtcgtaggggaactaggtagttccaacgttcctccgaacccgtccaaggtccaacggtcccgtaggggaacgtcccgtaggtacgttgggtttaaacttttcggtaacgtttacggttttaacctttcgtacgttacgtacggtacgtacggtcccggtttaccccgccccgtaaccgggtcccctcgtacccgttaccgggtttccgggggacccggggggtaaccgtacgggggttcggaacggtagtacgggaacggaacggtaacgtggtacgtccgtagaaccgtacctacgtctacgtcttacgactttccccg

SEQ ID NO: 346129 - DNA, 585 bp, Homo sapiens
  misc_feature: GZ8MTXP02FW33F.45.36.D03.1.454.CMB.2.raw
  modified_base (202)..(202): a, c, t, g, unknown or other
  misc_feature (202)..(202): n is a, c, g, or t
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctggtaccaacagaaacctggccaggcctcccaggcctcctcatccatgatgcatccaaacncgggtcccctgggccgtcccagaccaggttcccgnggcccaggtgggtctggggacagagttcactctcaccgtnagcagcctggacgcctgatgtatttgctagtttactctgtcagctacgtccgttcccgccgtacgcccgcgtcgtaccggtttcggggccgggggtaccgtagggggtcggaacggtagtaggaacggaacggtaaacggttcggtacggcgtacggccgtaaccgtattcgttacgttccttcgtacgtttcccg

SEQ ID NO: 346130 - DNA, 707 bp, Homo sapiens
  misc_feature: GZ8MTXP02H0YYZ.45.36.D03.1.454.CMB.2.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (362)..(362): a, c, t, g, unknown or other
  misc_feature (362)..(362): n is a, c, g, or t
  modified_base (420)..(420): a, c, t, g, unknown or other
  misc_feature (420)..(420): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaanagaaacctggccaggctccaggcctctacatccatgatcgacactccaaacgtcgggtccctggccgtccccagacgtcgggttccccgnggcctagggtcggggttctggggaactgggtacgtttcgaccttccgtacgacccgtnaacgcgacgcccgtgggacgtccgtagtacgttggttaacttttcgacgtttaacgttttactttaccgttagttccgtaaggtcgtaaccgggttccgttaccccgcccgtacccggtcccgttcgtcccggttaccgggtttccgggggtaccggggggaccgtacgggggtacgggtacgggtaacggtacggggaaacgggtaaccggtaacggtttggggaccgggtaacgtccgggtaaccctacccggtaactttcccggttaggtttacccgtttcccg

SEQ ID NO: 346131 - DNA, 637 bp, Homo sapiens
  misc_feature: GZ8MTXP02HLBUP.45.36.D03.1.454.CMB.2.raw
  modified_base (264)..(264): a, c, t, g, unknown or other
  misc_feature (264)..(264): n is a, c, g, or t
  modified_base (324)..(324): a, c, t, g, unknown or other
  misc_feature (324)..(324): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (527)..(527): a, c, t, g, unknown or other
  misc_feature (527)..(527): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagtaagtactaggctggtaccaanagaaacctggccaggcctcccaggcctcctcatccatgatgcatccaacgacgggtcccngggcctcccgagacctacgggttccgtggcccgtaggtcggggtctaggggacagngttccactcncaccgtnacgcacgccgtggacgcctggacttgtaatttttgaccttaggtttaccttcgtacgtcgtagtccgtacgtccgttccccgaccgaccgcccgtctaccgtacggtttccgggggccgggggtaaccgngggggttacgggagtacggttacggaaacgacggtaaacgttcgggtacggccgttacggaacccgtaccgtacttaccggttcgttaccgttccgtaactttcccccgg

SEQ ID NO: 346132 - DNA, 747 bp, Homo sapiens
  misc_feature: GZ8MTXP02GXPK5.45.36.D03.1.454.CMB.2.raw
  modified_base (264)..(264): a, c, t, g, unknown or other
  misc_feature (264)..(264): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgccaccctctcctgcagggccagtaggagtgtcagtaagtacttaggctggtaaccaanagaaacctggccaggcctcccgagcctcctcatccatgatgacatcccaacgtacgggtcccctgggcccgttacccagaccgtacggggttcccggtggcccagggtcggggtacgtaggggaaccaggtaacgtttccgaccttctaccaacccggtcaacggccaacggtcccgttaggggacgtcccgttaggacgttagttaagtttttcggaccgtttaacggtttttaccttcgtttcggttaccaacggtaccgtacggtcccgtttccccgtaccccggtaacccggccccggtccttacccggttacccggggttttcccgggggaccgggggggttaaccccgaaagggggttccggggtaaacggaggttacggaaacggggtaaaccgtaaacggttacgggttcgggtaaccgtcggaacccgtaaccccgtaagttccttacggtttcctttacctacgtttcccccg

SEQ ID NO: 346133 - DNA, 578 bp, Homo sapiens
  misc_feature: GZ8MTXP02FN9FE.45.36.D03.1.454.CMB.2.raw
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctgggagtgggtggccctcatttccgaagatggaagtgagaaggcctactcagactccgtgaaggccgctcaccatctccagagacaattccaagaatgtcctcttttgactaaatgaatagcctgagagttgagacacgtctgtcttnttctgtgccgagggggacatctatgagttntggttcgtagtagtaatacaactactactacgtacagtggacgtcgtacggggacgaaaagggtcccgtacggtacaccgtctccgacagccttaccgaccgacgggcccacgtccggtccttcccccgtggcccgtcccgtgcctccgacggtacgctacccgtcgg

SEQ ID NO: 346134 - DNA, 703 bp, Homo sapiens
  misc_feature: GZ8MTXP02G9VU5.45.36.D03.1.454.CMB.2.raw
  modified_base (211)..(211): a, c, t, g, unknown or other
  misc_feature (211)..(211): n is a, c, g, or t
  modified_base (277)..(277): a, c, t, g, unknown or other
  misc_feature (277)..(277): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgagggccaggtaggagtgtcaagtaagtacttaggctggtaaccaanagaaacctggaccaggcctcccgaggctcctcatccatgatgcatccaaacgcgggtccctggcctaccagaccgtaggttcccccgtggcctagggtcgggtcgtaggggaactagggtacgtttcaaccgttccgtccgtaaacccggtcgaacggtcccgaacgggtccccgttaggggaaccgtcccgttagtaaacgttcgggttaatttttcggaccgttaacgtttttaacccgttgttccggttaacgacggtcgtacggtcccggtttacccgaccccgtcgtcccggtctccggttaccgggtttcccgggggacggggggacccgtagggggtacggacggtacgtagggacggaacgtaacggtcggttagccgttacggaccctacgtacttaccggtttcgtaccgtttccc

SEQ ID NO: 346135 - DNA, 527 bp, Homo sapiens
  misc_feature: GZ8MTXP02JCN0Z.45.36.D03.1.454.CMB.2.raw
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctnatccatgatgcatccaacngggtcccctggcctcccagcaggttccgtggcccaggtgggtctggggacaggagttcactctcaccgtcagcagcctggancctgatgtatttgctagtttactctgtcagcagtcgttccgcctacgccgctcacgtttcggcgggggacaggggtcgagngtggacgacgaacgtgtacggctgcaccgtatccgtgttcttctactttcccg

SEQ ID NO: 346136 - DNA, 550 bp, Homo sapiens
  misc_feature: GZ8MTXP02JJITF.45.36.D03.1.454.CMB.2.raw
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (538)..(538): a, c, t, g, unknown or other
  misc_feature (538)..(538): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtgccctnattccgaagntggaagtgagagcctactcagactcgtgaagggccgcttcaccatctccagagacaattccaagaatgtcctcttttgcaaatgaatagcctgagagttgagacacgtctgtctatttctgtgccgagggggacatctatgagtntggtcgtagtgtatcaactactactacctnatggacgtcgnggggacgaaagggcctacggcaccgtctccgcagtctaccacgaacggcccagtccggtccttcccccgtggcccgccgtcgcctacgcggacnccgccgtccggg

SEQ ID NO: 346137 - DNA, 651 bp, Homo sapiens
  misc_feature: GZ8MTXP02I4DLY.45.36.D03.1.454.CMB.2.raw
  modified_base (444)..(444): a, c, t, g, unknown or other
  misc_feature (444)..(444): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcaggccagtaggagtgtcagtaagtacttaggctggtaccaacagaaacctggccaggctcccaggctcctcatccatgatgcatccaacgacgggtcccctgggccgtcccagaccgtacggttccgtggccaggtcggggtctggggaccaggtacgttccacgttctaccgaccgtcagccagcccgtggacgtcctgactgtattttgacttagtttaccttntgtcagtcacggtccgttcccgccgaccgtcccgtcttaccgtaccggtttccgggggaccggggggtaacccgtagggggtcggtaacgggtacgttaggggaaacggtaaacggtaaaccggttcgggttacggggccttacgggccctaaaaccccggttacgttccgttaccggtttaccctttaccgtaacccgtttccccg

SEQ ID NO: 346138 - DNA, 656 bp, Homo sapiens
  misc_feature: GZ8MTXP02IZGM2.45.36.D03.1.454.CMB.2.raw
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtactaggctggtaccaanagaaacctggccaggcctcccaggctcctcatccatgatgcatcccaanacggggtcccctgggccgtaccccagaccgtagggttcccgtggcccaggttcggggtcctaggggacaggtagttccacttcctaccgacccgtnacggctacgcccgtagggacgcctaggaattgtatttttcggcttacgttttacttcgtgttccagcctacggtccgttacccgcccgtaccggcccggtccttccgtaaccgggttttccgggggacccggggggtaccgtagggggtcgggtaaggacggttcgggaacggaaacggtaaacgtggggtacggccgttacggaacctacccggtaattccgttcggttaccgttcaaccgtttccccg

SEQ ID NO: 346139 - DNA, 568 bp, Homo sapiens
  misc_feature: GZ8MTXP02FPQTG.45.36.D03.1.454.CMB.2.raw
  modified_base (262)..(262): a, c, t, g, unknown or other
  misc_feature (262)..(262): n is a, c, g, or t
  modified_base (338)..(338): a, c, t, g, unknown or other
  misc_feature (338)..(338): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (552)..(552): a, c, t, g, unknown or other
  misc_feature (552)..(552): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaanagaaacctggccaggctccaggctcctcatccatgatgcatcccaacgcgggtcccctgggccgtcccagaaccgnggttccgtggcccaggtggctggggacaggtacgttccactctacgaccgtnagcacgctggacnctgatgtattgtcttagtttactcgtgtacagcacggtccgttcccgaccgaccgtcccgacttccgtacggtttcgggggaccgggggtaccgtagggggtcgacgagtacggaacggtacgaacgtggtacggctacggcaaccgtntctcgtctactctccg

SEQ ID NO: 346140 - DNA, 583 bp, Homo sapiens
  misc_feature: GZ8MTXP02HKATY.45.36.D03.1.454.CMB.2.raw
  modified_base (263)..(263): a, c, t, g, unknown or other
  misc_feature (263)..(263): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccaggtaggagtgtcagtaagtacttaggctggtaccaanagaaacctggccaggctcccaggctcctcatccatgatgcatcccaacgcgggtcccctgggccgtcccaagaccgtagggttcccggtggcccgtaggtggggtctaggggacaggtacgtttccacttctaccgaccgtcacgcacgccgtggacgcctgatggggtatttgctagtttacttctgtcagtcacgtccgttcccgccgaccgcccgctcgtacggtttccggggccgggggacgtaggggtggacggacgtaggacggtacggaacgtcggtacggcgtcgcactcgtcgtcgttcttcactttcccg

SEQ ID NO: 346141 - DNA, 639 bp, Homo sapiens
  misc_feature: GZ8MTXP02IICHP.45.36.D03.1.454.CMB.2.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccgagggganacacgccaccctctcctgcgagggccaggtaggagtgtacagtaagtacttaggctaggtaaccaanagaaacctggaccaggcctccgaggcctcctcatccatgatcgacaactcccaaagtacgggtcccctggccgttacccgaaggtaccgtagggttcccgnggtacccaggggttcgggtcgtggggacaggtacgttccaacgttctccgaccgtcacggacacggcctggacgtcctagacttgttagttttcgacttacgttttctcgtagtcgagtcgtacggtccgttccccgcgtacccgccgtacttcgtacgggttcgggggacgggggtaccagggggtacgaggtacgtggaacgtaacggtacgttgggacgtctacggaacctaacgtcgttcgtacgtttccttacgtactttccccg

SEQ ID NO: 346142 - DNA, 606 bp, Homo sapiens
  misc_feature: GZ8MTXP02F6JO9.45.36.D03.1.454.CMB.2.raw
  modified_base (382)..(382): a, c, t, g, unknown or other
  misc_feature (382)..(382): n is a, c, g, or t
  modified_base (449)..(449): a, c, t, g, unknown or other
  misc_feature (449)..(449): n is a, c, g, or t
  modified_base (590)..(590): a, c, t, g, unknown or other
  misc_feature (590)..(590): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctgggagtgggtggccctcatttccgaagatggaagtgagaaggcctactcagactccgtgaaggccgcttcaccatctccagagacaattccaagaatgtccttctttttgcaaatgaatagcctgagagttgaggacacgtctgtctntttctgtgcgagggggacagtctagtgagtctggttcgtagtagtaatctaaactactactacctanactaggtacgtcgtggggacaaaggggcctacggtcaccggttcgtccgcgtacgccttaccgacccgaaacgggcccctaaacgtccggttcccgtttccccccgtgggtcccgccccgtcggccttacccgacgggacnccgacccgttccgggg

SEQ ID NO: 346143 - DNA, 646 bp, Homo sapiens
  misc_feature: GZ8MTXP02GJE61.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggctcctcatccatgatgcatccaacgtcggggtcccctgggccgtcccagaccgtagggttcccgtggccccaggttcggggtctggggacaggtacgtttccaacttccgtaccgacccggtcaacggcctaacggcccgtagggacctcccgtagagttgttagtttcggactttaacgttttaccttcgtgttacacgtacgtacggtcccgttcccgacccgtaccgccccgtctccgtacggtttccgggggaccgggggaccgtagggggtcgaaggtaggtaggaacggaccgtacgtcgggtacggcttcggaactaacccgtcgttccgttgttccttacgtaccttcccg

SEQ ID NO: 346144 - DNA, 694 bp, Homo sapiens
  misc_feature: GZ8MTXP02J4A0D.45.36.D03.1.454.CMB.2.raw
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (392)..(392): a, c, t, g, unknown or other
  misc_feature (392)..(392): n is a, c, g, or t
tcagacgcgatcgacacgaccggtgctcgatttagctgcgtcacgatctctcttgggggccctggggaggaactgctcagttaggacccagagggaaccatggaagcccccagctcagcttctcttcctcctgctactctggctcccagataccaccggaaaattgtgttgacacagtctccaggccaccctgtctctgtctccgagggganaccacgcccaccctctcctgcgagggccagtaggngtgtacagtaagtaattacggctacggtaaccaacacgaaaccgtcggaccgacggcctcccgaggtcctcctcgactcccagttgactcgaccaactaccgacgaccgggtccctcggcctacccgagacgtacggttccccgnggtcgacgggtcggttcgaggggactggtcgttaccgtacctcgtaccgaccgtagacgtcacggtcccgtagggaccgtaccgtgtagttacgttacgttttcgaccgtttacgttttcctacgttcgacacggtcctacggtcccgggttacccccgccgtacccggtcccgtacgttccgggttaccggggtaccgggggacgggggtacgtaggggtacggaggtacggtacgtacgtacggtacggtcggtccgaacgtaccgacctacgttaccgttccgttacgtttacctaccg

SEQ ID NO: 346145 - DNA, 692 bp, Homo sapiens
  misc_feature: GZ8MTXP02JMA9H.45.36.D03.1.454.CMB.2.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (368)..(368): a, c, t, g, unknown or other
  misc_feature (368)..(368): n is a, c, g, or t
  modified_base (426)..(426): a, c, t, g, unknown or other
  misc_feature (426)..(426): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgcccaccctctcctgcagggccaggtaggagtgtcagtaagtacttaggctggtaaccaanagaaacctggaccaggcctcccgaggtcctcctcactccatgatgacactacccgaaacgtcggggttcccctgggccgtacccagaccgtacggttccggnggacccgtaaggtcggggtctaggggacaggtacgtttcaccgttctaccgacccgtnacgaccacggtcccgtagggaccgtcccgtagtagttgttaacgttttcggacctttagttttaccttcgttaggttccacggtctacggttcccgttacccgcccggtaccgtcccgtaccgttccgttacccgggtttccgggggccgggggtaaccgtagggggtacggtaggacggtacgggaaacggaaccggtaaacgttgggtaccggtacgttccgaaccgaccgtacgtcttacgttcctttaacggcctttccccg

SEQ ID NO: 346146 - DNA, 720 bp, Homo sapiens
  misc_feature: GZ8MTXP02H9WRA.45.36.D03.1.454.CMB.2.raw
  modified_base (204)..(204): a, c, t, g, unknown or other
  misc_feature (204)..(204): n is a, c, g, or t
  modified_base (265)..(265): a, c, t, g, unknown or other
  misc_feature (265)..(265): n is a, c, g, or t
  modified_base (435)..(435): a, c, t, g, unknown or other
  misc_feature (435)..(435): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaanagaaacctggccaggctcccaggcctcctcatccatgatgacataccaacgacggggttcccctgggcccgttacccgaaggaccgtacggggttccccggtggccccgtagggttcggggtccgtaggggaactagggtacgtttccaccgttctacccgtacccgttnacggccacggtccccgtgggaaccgtcccgtaggaacgtgtttaagtttttcggactttaacggttttaccttcgtagtaccgtaaggtcccgtaagggttcccgttacccggccccgtaaccggtcccgtccttaccggtaccggggtttcccggggggaccggggggtacccgtaagggggttcggaaggtacggttcgggaaacgtacgggaaccgttgggtacggtcgtcggaaccctaccgtacgtttcccgtagtttacccttctaaccgtttcccccg

SEQ ID NO: 346147 - DNA, 550 bp, Homo sapiens
  misc_feature: GZ8MTXP02F3IXV.45.36.D03.1.454.CMB.2.raw
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (445)..(445): a, c, t, g, unknown or other
  misc_feature (445)..(445): n is a, c, g, or t
  modified_base (483)..(483): a, c, t, g, unknown or other
  misc_feature (483)..(483): n is a, c, g, or t
  modified_base (518)..(518): a, c, t, g, unknown or other
  misc_feature (518)..(518): n is a, c, g, or t
  modified_base (541)..(541): a, c, t, g, unknown or other
  misc_feature (541)..(541): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctnatttccgaagntggaagtgagaaggcctactcagactccgtgaaggccgcttcaccatctccagagacaattccaagaatgtcctcttttgcaaatgaaatagctgagagtgagacacgtctgttctatttctgtgccgagggggacagtctaagtgagtcgtggttcgtagtgtaatcaacttactactacctnatgacgtgtggggacaaaggacctcgggtcaccggtcnccgcagcctaccacacggcccatccgtcctccccnggcccgccgtcgcgtccgagacncgcctcggg

SEQ ID NO: 346148 - DNA, 540 bp, Homo sapiens
  misc_feature: GZ8MTXP02FUW9P.45.36.D03.1.454.CMB.2.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggctcccaggcctcctcatccatgatgcatccaancgggtcccnggccgtccagacnggttccgnggccaggtgggtctggggacagtacgttcactctacaccgtnagcagcctggacnctgatgtatttgtagtttactgtgtcagtcagtccgttcncctacgccgtcctcgtacgttcgggcgggtgaccgtaggggtgacgagtggacgtacgaacgtggtacgctcgaactaccgtatcgtcgttctactcttcccg

SEQ ID NO: 346149 - DNA, 697 bp, Homo sapiens
  misc_feature: GZ8MTXP02JQQVD.45.36.D03.1.454.CMB.2.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcgaggtggtggaggtcgggggagcgttgtccgagccgtgggacgtccctgacgtctctcctgtgcagcctctggattccnccctntacgttaacttttcggttccacgtcgggtccgccacggttcccaggcgaaggggctggacggtgggtcgccctgtacgtttccgaaagtcgtacgggaagtgaacgaacggcccttaacgcgacgaccgtccggtggaacggccgtcttacacacgtcctcaacgagactaagttaccaagaattcgtccttacgttttacgactaaagtacgtaaactcgtacccgtaggtaacggtagtttacggaacggggtaaccgtaacggttccgtttaaggtctttaaacgtttccggttacggttacggaccccggggttaaagggggactaaccgttcgttaaacggttacgtaaggtttcggttacggtttaccggttacgggttaagttaacgttaaccgtttaaaacccg

SEQ ID NO: 346150 - DNA, 565 bp, Homo sapiens
  misc_feature: GZ8MTXP02GXA14.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (433)..(433): a, c, t, g, unknown or other
  misc_feature (433)..(433): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaanagaacctggccaggctcccaggctcctcatccatgatgcatccaacgcgggtccctgggccgtccagacgtaggttccgtggccctaggtgggtcgtggggacaggtagttccacttctaccgaccgtcagccagccgtggacgcctgatgtatttcgacttagtttactntcgtcagctagtccgttccgccgacgcccgtctccgtacggtttccggggcgggggaccgtgggggtcggtacgagtggacggaccgaacgttggcggctaggcaaccgagttcgtcgtcttacactttccc

SEQ ID NO: 346151 - DNA, 602 bp, Homo sapiens
  misc_feature: GZ8MTXP02I6Z5C.45.36.D03.1.454.CMB.2.raw
  modified_base (210)..(210): a, c, t, g, unknown or other
  misc_feature (210)..(210): n is a, c, g, or t
  modified_base (270)..(270): a, c, t, g, unknown or other
  misc_feature (270)..(270): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcaggccagtaggagtgtcagtaagtacttaggctggtaccaanagaacctggccaggctcccaggctcctcatccatgatgcatccaacgcgggtccctggccgtcccagaccgaggttccccgtggcctaggtgggtcgtggggactaggtacgttcaccttcgtaccaacccgtcaagcacgccgtggacgcctagtatggtatttgctacgtttacttcgttgtcgagtcgtacgtccgttcccgcccgtccggcccgtccgtcgtaccggtttccggggacgggggtaccggtacgggggtacggaggtacgtagggacgacgaacgttggtacgggtcgtcggaccgaacctactcgttcgtctttaccg

SEQ ID NO: 346152 - DNA, 763 bp, Homo sapiens
  misc_feature: GZ8MTXP02JTYPO.45.36.D03.1.454.CMB.2.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagacgcgatcgacacgaccggtgctcgatttagctgcgtcacgatctctcttggggaggaactgctcagttaggacccagagggaactatggaagcccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggcctcccaggctccncactccatgatgcataccaacacggggtcccctgggccgtcccaggacgtacgggttcccgtggcctaggggtcggggtacgtgggggaactaagggtcgtttccgaccttcgttaccgaaccccggtcaacggcccacggcccgtacgggaaccggtccctagggaacttcggttaagtttttcggaccgtttaacgggtttttaacctttcgttcgggtttaccacggggttacctaccgggttacccggtttaccccggccccgtaacccgggcccccgttccgttacccggttaacccgggttttccgggggaccccgggggggttaaaccgtacggggggttacggggaacggtacggttagggaacggaaaccgggtaaaccggtacgggtttacggccgttacggtaacccgaacccgttaacgttccgtttcggttaccctttaaccgtaccttttcccccg

SEQ ID NO: 346153 - DNA, 631 bp, Homo sapiens
  misc_feature: GZ8MTXP02IZ6UE.45.36.D03.1.454.CMB.2.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
  modified_base (415)..(415): a, c, t, g, unknown or other
  misc_feature (415)..(415): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtcctccgagggganacacgccaccctctcctgcagggccaggtaggagtgtcaaggtaagtacgttaggctggtaaccaacaagaaaccctggaccaggcctcccgaggcctcctcatccatgatgcatcccaagcgggtccctggcctcccgagacgcggttccgnggccaggtcgggtctggggacagtacgttcactctcaccgtgacgtcacgccgtggacnccgtgattcgtattttcgacttagtttcttcgtcgtacacggtcgacgttccgttccccgcgtacccgcccgtcgtccggtaccgggtttcgggggaccgggggtaccggagggggttcggagtacggaaggtacggaaccgtaacggttcgggcggtacgtacggtaaccgaccgttacgttcgttcggttaccctttactaccgttttcccccg

SEQ ID NO: 346154 - DNA, 615 bp, Homo sapiens
  misc_feature: GZ8MTXP02I7VY3.45.36.D03.1.454.CMB.2.raw
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (457)..(457): a, c, t, g, unknown or other
  misc_feature (457)..(457): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggctcctcatccatgatgcatccaacncgggtccctggccgtccagacctggtccccgngcaggtggtcgnggacnggtacttcactctcaaccgtcagcagcccgtggacgctgatcgtatttcgacttagtttacttcttagtcacggtcacgtccggttccnccgacgtcccgtcttcgtaccggtttccgggggaccgggggtaccgtacgggggttcgaacgggacggttacgggaacgggaacggtaaaccggttgggtaacgggaacccgttggaaccctacccggtaagtttccgttcggtttacctttacccgg

SEQ ID NO: 346155 - DNA, 594 bp, Homo sapiens
  misc_feature: GZ8MTXP02H85ZW.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcagggccagtaggagtgtcagtaagtacttaggctggtaccaanagaaacctggccaggctcccaggctcctnactccatgatgcactccaacgacgggtcccctgggcctacccagaccgtagggttccgtggcccgtaggtcggggtctggggacaggtactttcgacttctaccgaccgtnagctagccgtggacncctgatgtattttcgacttagtttacttctgtacagtcacgtccgttcccgccgaccgtccgacctcgtaccggttcggggcgggggaccgagggggtgaggagtggacgtaacggaacgttggcggtcgtacggccaccgttagttccgttcgttccgtttactaccgtttccccg

SEQ ID NO: 346156 - DNA, 630 bp, Homo sapiens
  misc_feature: GZ8MTXP02I5RWB.45.36.D03.1.454.CMB.2.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggggaggtgtgtcacaagatttgggctctgggcaccgtgggcatgggggagcgttgtccagcctgggaggtccctgagactctcctgtgcagcctctggattcctccctnagttaactttggttccacgtcgggtccncctaggttcccagggcgaaggggctggagtgggtcggccctctatttccgaagatggaagtgagaaggcctactcagactccgtagaacgggccgcttcaccatcctccaagagaaccaacttacccaaagtaattcgtaccttctttttgactaaaattgaaaatacgacctagaacgtagttggaaggactaacgttctagttacttatttcgtgtcgaccgagggggactatctagtgagttcgtgttacgtagttagtaatactaacttactaactactactagtacggtacgtagtcgggacgaaaacgggtccgtcggtaaccgtaaccgtacctccgactaccgtccttacccgaaacccgg

SEQ ID NO: 346157 - DNA, 650 bp, Homo sapiens
  misc_feature: GZ8MTXP02G2KK6.45.36.D03.1.454.CMB.2.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcgttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccacctctcctgcagggccagtaggagtgtcagtaagtacttaggctggtaaccaacaggaaacctggaccaggcctcccgaggcctcctcatccatgatgcatcccaagcgggtccctagggccgtacccagaccgtaggttcccggnggccgtgggtcggtcgtagggactagtacgttccacgtcctaccgtaccgtcgacgccacggcccgtaggacctcgtagtacttgttactttcgactttacgtttctcgtgtacgcgtacgtacggtcccgttacccgccgtaccgcccgtccgtccggttaccgggttccgggggaccggggtaacgtagggggtcggaacggtcggtacggaacggtaacggtacggttcgggtacggccgtacggaaccgtacgttcgttcgttaccgttcctttacctaccggtttcccc

SEQ ID NO: 346158 - DNA, 748 bp, Homo sapiens
  misc_feature: GZ8MTXP02JC16X.45.36.D03.1.454.CMB.2.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagaccaccctctcctgcagggccaggtaggagtgtcagtaagtacttaggctcggtaaccaanagaaccnggccaggcctcccgaggcctccncactccatgatcgcaactaccaacgtacgggtcccctcgggcccgtacccgaggaccgtacggttccggtggccgtagggtcgggtcgtaggggaactaggacgtttccaccttcgtacccgtaccgtcacgtccacgtccgtggggacctccgtaggtattggttactttcggtacgtttaagttttaccttcgttcgttacgacgtaccgtaccggttcccgttccccgacccgtacccggtcccgttccttacccgggtttacccggggtttaccggggggacccggggggtaacccggtagggggttacgggaacgggtaacggtcggggtaaaaccgggtacccggtaaacggttccggggttaacggggccgttacgggaacccgtacccggttagtttccccggttacggtttcccgtttaacccgtacccgtttacccccgg

SEQ ID NO: 346159 - DNA, 648 bp, Homo sapiens
  misc_feature: GZ8MTXP02GMFGV.45.36.D03.1.454.CMB.2.raw
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctcaggcaccctgtctctgtctccagggganacagccaccctctcctgcagggccaggtaggagtgtcagtaagtacttaggcttggtaccaanagaaacctggccaggcctccaggctccnactccatgatgcactccaaacgcgggttacccctgggcccgtacccaggtacctacggggtttccccccgtgggctaagggttcggggtaccgttagggggaacctgggtaaccgtttaccaaccgtttccgttaccgaacccgttcaaacggccgacgtcccgtagggacgcccgttggattcgtagttttcgacttagtttaccttcgtgtacctagcgtacgccgttcccgcccacgtcccgctaccgtacgttcgggggaccgggggtactaggggtcggtagacgttaggacgacgtaacgtggtcggaacgtggacctacgtgttactcggttactttcccg

SEQ ID NO: 346160 - DNA, 671 bp, Homo sapiens
  misc_feature: GZ8MTXP02HMHQS.45.36.D03.1.454.CMB.2.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccaggcaccctgtctctgtctccgagggganacagccaccctctcctgcgagggccaggtaggagtgtcagtaagtacttaggctggtacccaanagaaacctggaccaggcctcccgaggcctcctcatcccatgatgccatccaacgacggggtcccctgggcctcccgagaccgtagggttcccgtggccccgtaggttggggtctaggggtaacaacggttcgtttccaacctttccgacctaacccgggttcacggcctacgcccgtggaccgtcctggattgtatttttcggactttacggttttaccttcgtcgtacgtacgtcgtacggtccgttcccgaccgtaccgtcccgtcttacggtaccggtttccgggggaccgggggtaccgtagggggtcggtacggacgttcggggaacggtaacggtaaccggttgggtccggcttcggaaccgtacctacgtttcgtgtttcccttcgttaccgtttcccg

SEQ ID NO: 346161 - DNA, 601 bp, Homo sapiens
  misc_feature: GZ8MTXP02GNQXR.45.36.D03.1.454.CMB.2.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtaagtacttaggctggtaccaacagaaacctggccaggctcccgagctcctcatccatgatgcatccaacgagggtccccnggcgtcccagaccgtagggttcccgtggcccgtaggtcggggtactggggacaggtacgtttcacctctcgaccgtcagcacgccgtggacgccgtgagttgtatttgcttagtttacttcttgtacagcacggtccgttcccgcccgtacgcccgtccgtccgtcggtttaccgggggccggggggtaccgtagggggtcggaggacggtaggaacggaccgtaacggtcggtacggcgtcggaactaccgtacttcgtcgttccttctacttccccg

SEQ ID NO: 346162 - DNA, 613 bp, Homo sapiens
  misc_feature: GZ8MTXP02JYW68.45.36.D03.1.454.CMB.2.raw
  modified_base (251)..(251): a, c, t, g, unknown or other
  misc_feature (251)..(251): n is a, c, g, or t
  modified_base (375)..(375): a, c, t, g, unknown or other
  misc_feature (375)..(375): n is a, c, g, or t
  modified_base (443)..(443): a, c, t, g, unknown or other
  misc_feature (443)..(443): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccgccaggttccaggcaaggggctggagtgggtggccctnatttccgaagatggaagtgagaaggcctatcagactccgtgaaggccgcttcaccatctccagagacaattccaagaatgtaccttcttttgctaaatgaatagcctgagagttgagacacgtntgtcttatttctgtcgccgagggggacatctatgatcgtgttcgtagtgtatcaactactactacctnatggacgtgtagggcgaaaacggggcctccgggtacacccggtctacccgctacgtcccttaccgaccccgaaggggccccctaagttcccgggttccctttcccccccggtcggttccccgccccgttcggcccttacccgacggtaccgaccgtccgttacccggggg

SEQ ID NO: 346163 - DNA, 734 bp, Homo sapiens
  misc_feature: GZ8MTXP02G0NI0.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccaggctcctcatccatgatcgcactacccaacgacggggttcccctgggcccgtacccgaggaccgtaggggttcccggtgggcccctaggggttggggtaccgtggggaacctaggacgtttccaaccgttccgtccgacccgttcgagtccacgccgtggacgtcctgtattgtattttgactttacggttttaccttcgtcgttacgtacgtacgtcggttcccggttccccgcccgtaacccggtcccgtcccgttaccggttacccgggttttcccggggggcccggggggtaaccccggtaagggggtcggggtaaacgggtacggttacggggaaacgggtaaaccgggttaaccggttaggggttccgggaaccgttcgggaacccgtaaacccgttacgtttcccggttacggtttccctttacccggtacttttccccccgg

SEQ ID NO: 346164 - DNA, 576 bp, Homo sapiens
  misc_feature: GZ8MTXP02JXW4R.45.36.D03.1.454.CMB.2.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (392)..(392): a, c, t, g, unknown or other
  misc_feature (392)..(392): n is a, c, g, or t
  modified_base (406)..(406): a, c, t, g, unknown or other
  misc_feature (406)..(406): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccagggganacagccaccctctcctgcagggccaggtaggagtgtcagtaagtacttaggctggtaaccaacgagaaacctggccaggctcccgaggctcctcatccatgatgcatccaagngggtcccctgggccgtcccagacgtaggttccgtggcccaggtcgggtctggggacagagttcacctctcaccgtnacgcagcctggacncctgatgatttgcttagtttactctgtcagtcagtccgttcgcccgtacgccgtacctacgttccgggttccgggggacggggtaccgtagggggtgaacggtgtaggaacgaaaccggtggtcgggcgctacgccaaccgtctcggttacttcctacttacgttccccg

SEQ ID NO: 346165 - DNA, 578 bp, Homo sapiens
  misc_feature: GZ8MTXP02IDED4.45.36.D03.1.454.CMB.2.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtactaggctggtaaccaacagaaacctggccaggcctcccgaggcctccncatccatgatgcatccaancgggtccccngggcctcccagacgaggttccgtggcctaggtgggtctggggacagacgttcactctcgaccgtcagcacgccgtggacgcctgatgttagtttgcttagtttactctgtcagtcacgtccgttccgccacgtcccgctcgtacggtttcggggaccgggggaccgagggggtaggaaacgtggtaacggaacggtaacggtacggttcggcgtcggccgaacgtacttcgtacgttctttctactccgttccccg

SEQ ID NO: 346166 - DNA, 572 bp, Homo sapiens
  misc_feature: GZ8MTXP02FYEMT.45.36.D03.1.454.CMB.2.raw
  modified_base (263)..(263): a, c, t, g, unknown or other
  misc_feature (263)..(263): n is a, c, g, or t
  modified_base (559)..(559): a, c, t, g, unknown or other
  misc_feature (559)..(559): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaccaanagaaacctggccaggctccagctcctcatccatgatgacatcccaaacgtcgggtcccctagggcctccccagaccgagggttcccgtggccccgaggtcggggtctaggggacaggtagttcactctccgaccgtcaagctacgcctggacgcctaggatgtatttcgacttagtttacttcgtgttacacgtctacggtcgttcccgccaccgcccgtctacgtccgtttcgggcgggggaccgtaggggtggacgtagtaggacggacgtaacgtgtcgctgcgactctcgtntctactacttccc

SEQ ID NO: 346167 - DNA, 605 bp, Homo sapiens
  misc_feature: GZ8MTXP02G08ZW.45.36.D03.1.454.CMB.2.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (398)..(398): a, c, t, g, unknown or other
  misc_feature (398)..(398): n is a, c, g, or t
  modified_base (453)..(453): a, c, t, g, unknown or other
  misc_feature (453)..(453): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtctaggctggtacaanagaaacctggccaggctcccgaggctcctcactccatgatgcactccaacgtacgggtcccctgggcctcccaggacgtacgggttcccgtggcccgtaggtgggtcgtggggaccaggtgttccactctacgaccgtnacggtcacgtccgtggacgtccgtagattgtaattttcggacttaggtttacctntcggttacagtctaggtccgttcccgccgtacgcccgtcttaccgtacggttccgggggaccggggtacgagggggtcgagtacgtaggaacggtaccgtaagtcgggtacgctacggaacacgtactcctgtcccttctaccgtttccccg

SEQ ID NO: 346168 - DNA, 624 bp, Homo sapiens
  misc_feature: GZ8MTXP02GFIDX.45.36.D03.1.454.CMB.2.raw
  modified_base (266)..(266): a, c, t, g, unknown or other
  misc_feature (266)..(266): n is a, c, g, or t
  modified_base (375)..(375): a, c, t, g, unknown or other
  misc_feature (375)..(375): n is a, c, g, or t
  modified_base (513)..(513): a, c, t, g, unknown or other
  misc_feature (513)..(513): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagcccaccctctcctgcagggccagtaggagtgtcagtaagtacttaggctggtaccaanagaaacctggccaggcctcccaggcctcctcactccatgatcgacactacccgaaacgtacggggttcccctgggcccgtacccgaggtaaccgtacggggttcccggngggccccgtagggtggggtctaggggactaggtcgtccactctcgaccgtcacgcacgccgtgggactcctgattgtacttttcgactttacgtttactcgtggtacagcgtacggtcccgttccgccgaccggtccncgttccgtaccggtttcgggggaccgggggaacgtgggggtaggacgacgtggacggtaacggtacgtggtacgcgtgaaccgtaccgtactcgtacgttctctacctccg

SEQ ID NO: 346169 - DNA, 547 bp, Homo sapiens
  misc_feature: GZ8MTXP02F0E9P.45.36.D03.1.454.CMB.2.raw
  modified_base (249)..(249): a, c, t, g, unknown or other
  misc_feature (249)..(249): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaactttggtttccactgtgtccgccaggttccaggcaaggggctggagtgggtggccctnatttccgaagatggaagtgagaaggcctatcagactccgtgaagggccgcttcaccatctccagagacaattccaagaatgtcctctttttgctaaatgaaatagcctgagagttgaggacacgtctgtctattctgtgccagggggacatctatgagtctggttcgtagtgtaaatcaaactactaactacctcatggacgtcgtaggggacaaaacgggcctacggtcaccgtctccgcacgcttccactacgggcccatcgtcctccccgtgccgccctgcctcacgcgctaccg

SEQ ID NO: 346170 - DNA, 557 bp, Homo sapiens
  misc_feature: GZ8MTXP02JGBFX.45.36.D03.1.454.CMB.2.raw
  modified_base (250)..(250): a, c, t, g, unknown or other
  misc_feature (250)..(250): n is a, c, g, or t
  modified_base (379)..(379): a, c, t, g, unknown or other
  misc_feature (379)..(379): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtggccctnattccgaagatggaagtgagaaggcctatcagactcgtgaaggccgcttcaccatctccagagacaattccaagaatgtcctcttttgactaaatgaaatagcctagagagttgagacacgtctgtctnttctgtgccgagggggacatctatgagtcgtggttcgtagtataagtctaactactactactcagtggactcgtggggacaaagggcctcggtcacgtctccgacacgccttaccaccgaggccccagtcccggtccttccccgtggcccgcctcgcctccgagacgccacgtccggg

SEQ ID NO: 346171 - DNA, 614 bp, Homo sapiens
  misc_feature: GZ8MTXP02GMDJX.45.36.D03.1.454.CMB.2.raw
  modified_base (212)..(212): a, c, t, g, unknown or other
  misc_feature (212)..(212): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagccaccctctcctgcagggccagtaggagtgtcagtaagtacttaggctggtaccaanagaaacctggccaggctcccagctcnatcatgatgcatcccaaagtacgggtccctgggccctacccgagtaacctagggttccccgtgggcctagggttcggggtctaggggacctaggtacgtttcaaccgttcgtaccgaaccgtcaagccaacggccctagggaacgtccgtagtatggtattttgacttagtttacttcgttgtacagtcgacgtccgttccgcccgacgcccgtctcgtaccggttcgggggaccgggggtacctaagggggtggaagtacgtaggaacggaccgtaacgtggtaggcgtcgactaccagttctcgttctttacg

SEQ ID NO: 346172 - DNA, 612 bp, Homo sapiens
  misc_feature: GZ8MTXP02GV4L7.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctaggtaccaacagaaacctggaccaggcctcccgaggcctcctcactccatcgatgcactacccaacgtacgggtccctgggccgtcccagtaccgtacggggttcccgtggccccgtagggtcgggtcgtacggggacaggtacgttcgacctctaccgaccgtcgacgcacgtccgtggacgcctgtactgttattttcgacttacgtttacttcgtgttacagtcacggtccgttcccgcctacccgccgtcctacgtaccggtttcgggggaccgggggtaccgaggggtcgagacgtaggaacgtacggacgtggcgctcgaacctacacgttcgtcttacttcctacgttcccc

SEQ ID NO: 346173 - DNA, 677 bp, Homo sapiens
  misc_feature: GZ8MTXP02J3G3O.45.36.D03.1.454.CMB.2.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctgctcccagataccacgaaaattgtgttgacacagtctccaggcaccctgtctctgtctccagggganacagcccaccctctccctgcagggccaggtaggngtgtcagtaagtactaggctggtacaacagaaacctggccaggcctcccaggctcctcatccatgatcgcatacccaaacgtacggggttcccctggggccgtcccaggacctagggtttcccccgngggcctaggtggggtctggggacnggtacgtttccaccgttcctccacccggtcagccagtcccgtggacgcctagtattaggttatttttggccttaaggtttttacctttctcggttaccagtaccgtacggtccggtttcccgaccccgtaccggccccgtccgttaccgtaccggtttttaccggggggccggggggaaacccgggtacgggggttgggaaggtacgttacgggaacggaaccggtaaaccgttggttcgggtctcggacctacccgtaactttcctttacgttaccttttacccg

SEQ ID NO: 346174 - DNA, 591 bp, Homo sapiens
  misc_feature: GZ8MTXP02HVU08.45.36.D03.1.454.CMB.2.raw
  modified_base (249)..(249): a, c, t, g, unknown or other
  misc_feature (249)..(249): n is a, c, g, or t
  modified_base (351)..(351): a, c, t, g, unknown or other
  misc_feature (351)..(351): n is a, c, g, or t
  modified_base (461)..(461): a, c, t, g, unknown or other
  misc_feature (461)..(461): n is a, c, g, or t
tcagacgcgatcgacacgaccggtgctcgatttagctgcgtcacgatctctcttgggttttgggggaagaggaagactgacggtcctcccaggagttcaggtgctgggcaccttgggcacgggggaggcgttgtccagcctgggaggtccctgagactctcctgtgcagcctctggattctccctcagtaacttttggtttccactgggtccgccaggttccaggcaaggggctggagtgggtgccctnatttccgaagatggaagtgagaagcctactcagactccgtgaaggccgcttcaccatctccagagacaaatttccaagaaatgtccttctttttgcaaattnaatagcctgagagttagagacacgtctgtcttatttctgtgccgagggggacatactatgagtcgtggttcgtagttgtaaatcaacttactactactcatggacgttgnggggcaaagggctcggtacaccgtctccgcacgctttccgaacccgtacggggaccctagtcccggttccttcccccgtcgggccgtccccgtcggtacctccgtaacggaccgccgtaaccctccgggg

SEQ ID NO: 346175 - DNA, 710 bp, Homo sapiens
  misc_feature: GZ8MTXP02GIIOA.45.36.D03.1.454.CMB.2.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggttccactgggtccnccaggttccaggcaaggggctggagtgggtgcctnattcgaagntggaagtgagagctactcagactccgtgaaggccgcttcaccatctccagagacaattccaaagaatgtccttctttttgactaaatgaaatagcctgagagttgagacacgtctgttcttatttcgtgttgacccgagggggtacagtctatgtagtctgggttacgtagttagtaactactaaactacttaactaccttactagtacggtaccgttacgacgggggtacgaaaacgggggtaccctaccggggtacctaacccccggtcgttccccggaccgtaaacggtccccctttaacccgtaaaccccggaaaccgggggtccccctaaaccggttccccgggttcccctttaccccccccggttccgggcccccggtcccccgtttccgggcccccttaccccgggaaccggtaacggcccccggtaaccccgtttaccccggggg

SEQ ID NO: 346176 - DNA, 694 bp, Homo sapiens
  misc_feature: GZ8MTXP02F2F5F.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaacagaaacctggccaggcctccgaggctcctcactccatcgatcgacatccaaacgtcgggtccctgggccgtcccaagacgtacggttcccggtggaccccgtagggtcgggtactaggggacaaggtacgtttccgactccttacgacccgtcaacgcgtaacgcccgtgggacgcccgtagacgttgtaacttttggactttacgtttacttcgtacgttcaagtccaacggtccgtttccgtaccaccggttccccgtataccggttacccgggtttacgggggcccggggggtaaacccgtagggggttacggaacggtagttacgggaaacggtaaaccgggtaaacgttcggggtaacggccgttacgggaaccctaaacccggttacgttaccgttacggtttaccttaccgtacccgtttcccg

SEQ ID NO: 346177 - DNA, 690 bp, Homo sapiens
  misc_feature: GZ8MTXP02G3CKD.45.36.D03.1.454.CMB.2.raw
  modified_base (213)..(213): a, c, t, g, unknown or other
  misc_feature (213)..(213): n is a, c, g, or t
  modified_base (355)..(355): a, c, t, g, unknown or other
  misc_feature (355)..(355): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggccaccctgtctctgtctccgagggganacacgccaccctctcctgcgacgggccaggtaggagtgtacgagttaagtacgttaggctaggtaaccaacgaacgtaaacctggaccaggcctacccgaggcctcctcactccatgatgacactaccaacgtacgggtccnggcccgtaccaggacgtacggttccccgtaggcgtaggtcggggtcgtaggggactaggtacgttacaccgttccgacccgtaccgtcgacggccacggcccgttaggaccgccgtagtagttacggttagtttttcggactttacgttttacttcgtacggtctaaggtcgcggttcccgttcccgaaccggcccgtcccggtcttaccggttcccggggtttcgggggaccggggggtaaccgttagggggcggtaaggacggttacggaacggtaaccggtaacgtgggttggccgtacggtccctaacggtccttcggtcgtttacctccg

SEQ ID NO: 346178 - DNA, 553 bp, Homo sapiens
  misc_feature: GZ8MTXP02H4PJP.45.36.D03.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (311)..(311): a, c, t, g, unknown or other
  misc_feature (311)..(311): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccaggtaggagtgtcagtagtacttaggctggtaccaanagaaacctggccaggctcccaggctcctcatccatgatgcatccaagngggtcccctgggcctcccagactaggttccgtggcccaggtgggtctgggacagacgttcactctcaccgtcagcagcctggacgcctgactgtatttgactagtttacgtcttgtcagctacggtcttccgcccgacgcccgactcgtacgtttccggggacgggggtaccgagggggtcgaggagtggacggtaacggacgtgtacgggcctggccaccgatcgtgtccttcacttcccg

SEQ ID NO: 346179 - DNA, 617 bp, Homo sapiens
  misc_feature: GZ8MTXP02GJ83F.45.36.D03.1.454.CMB.2.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
  modified_base (443)..(443): a, c, t, g, unknown or other
  misc_feature (443)..(443): n is a, c, g, or t
  modified_base (594)..(594): a, c, t, g, unknown or other
  misc_feature (594)..(594): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgccagggccaggtaggagtgtcagtaagtacttaggctggtaaccaanagaaacctggccaggcctcccgaggctcctcactcccatgatcgcactcccaaagtacggggtcccctgggcccgtcccaagaaccgtaggggtttccccgngggcccctaggggttcgggtacgtaggggacaggtacgtttccacttctaccgacccgtnagcacgccgtggacncgtgacttgtatttcgacttagtttacttgtgtacgagtcacgtccgttcccgcccgtacgcccgtactcgtaccggtttcgggggaccgggggaccgtagggggtcggaagacgtagacggtaacgaacgtcggtcggctacgcgtaccngttctgttccttcgactttcccg

SEQ ID NO: 346180 - DNA, 676 bp, Homo sapiens
  misc_feature: GZ8MTXP02IU8Q4.45.36.D03.1.454.CMB.2.raw
  modified_base (353)..(353): a, c, t, g, unknown or other
  misc_feature (353)..(353): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtagtacttaggctaggtacaacgagaaacctggaccaggctcccaggcctcctcatccatgatgcatcccgaagcgggtcccctgggccgtacccagacgtagggttcccggnggccgtaggtcgggtcgtaacggggactaggttacgttcctaccttcgtacccgtaccgtcacgccacggtcccgaggtactccgtagtacgttgttacgttttcgtcttaacgttttcctcgtcgtacgtagtaccgtacgttcccgtcccgacccgtacccggtcccgtccgttaccggttacgggtttccgggggacccgggggtacgtagggggtacgtaacggtacggtacggaaaccggtaacgtacggttcggtaccggtactacggtaacccgtaacgtacgttccgttagttccgtttaccgttaccgttcccg

SEQ ID NO: 346181 - DNA, 618 bp, Homo sapiens
  misc_feature: GZ8MTXP02F4GL6.45.36.D03.1.454.CMB.2.raw
  modified_base (213)..(213): a, c, t, g, unknown or other
  misc_feature (213)..(213): n is a, c, g, or t
  modified_base (342)..(342): a, c, t, g, unknown or other
  misc_feature (342)..(342): n is a, c, g, or t
  modified_base (459)..(459): a, c, t, g, unknown or other
  misc_feature (459)..(459): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtcactgagactctcctgtgcagcctctggattctccctcagtaactttggtttccactgggtccnccaggttccaggcaaggggctggagtgggtggcccccattccgaagatggaagtgagaaggcctactcagactccgtgaaggccgctcaccatctccagagacaattccaaagaatgtccttctttttnacaaatgaaatagcctagagagttagagacacgtctgttctatttctgttgacccgagggggaacagttctaatgagtcttggttcgtagttagtaatcaaacttactactacctanagtgacgttcgtggggacaaaacggggacctcggtctaaccgtctccggacacgtccttacccgaacccgtaaacggggccccaaacgttcccggtacccttcccccgtcgggtcccgccccgtcgaccctcccgaacggaccgcctaacccgtccggg

SEQ ID NO: 346182 - DNA, 673 bp, Homo sapiens
  misc_feature: GZ8MTXP02G0IRW.45.36.D03.1.454.CMB.2.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (443)..(443): a, c, t, g, unknown or other
  misc_feature (443)..(443): n is a, c, g, or t
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtctccagggganacagcccaccctctcctgcgagggccagtaggagtgtcaagtaagtacttaggctggtaaccaanacgaaacctggccaggcctccgagcctccncatccatgatgcactacccaacgacggggtcccctgggcccgtacccgaagtaccgtacgggtttccggcgggcccgtaggggtgggtccgtaggggactagggtacttcgactccgtaccgaccgtcgaggacgcccgtggacncgtagatgtatttgacttagtttactntagtcacgtcgtacgtccggttccnccgtaccggccccgtacgttaccgtacccgggtttccgggggaccggggggtaccgtagggggtacgggaaggtaggtacggaaagggtaaccggtaaggttcgggacgggtccttaacggaccctaaaccgtcggtttcttaccggttcctttactacccgtttcccgtttaccccg

SEQ ID NO: 346183 - DNA, 615 bp, Homo sapiens
  misc_feature: GZ8MTXP02JHU8F.45.36.D03.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (463)..(463): a, c, t, g, unknown or other
  misc_feature (463)..(463): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaatacgttaggctggtaaccaanagaaacctggccaggctcccgaggctccncatccatgatgacactaccaaacgtcggggtcccctgggccgtcccaggacctagggtttcccgnggcccctagggtcgggtctacggggactaggtcgttccacctctcgaccgtcacgcacgccgtgggacgtcctggatgttattcgctaagttttcctcgtgtacgngcgtacggtccgttcccgaccgtaccgcccgtcttaccggtccggttccgggggcgggggtacccgtgggggtaggaccgtaggtgacggtacgacgttgggtccgacgttcgaacccgtacgtatccgtagttcccttacgtctttccccg

SEQ ID NO: 346184 - DNA, 573 bp, Homo sapiens
  misc_feature: GZ8MTXP02HGGVH.45.36.D03.1.454.CMB.2.raw
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (386)..(386): a, c, t, g, unknown or other
  misc_feature (386)..(386): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaaccaanagaaacctggccaggctcccgaggcctcctcatccatgatgcatccaaacgcgggtccctgggccgtccagactaggttccgnggccaggtgggtctggggacagagttcactctcaccgtnagcagccgtgcgcctgatgtatttgattagtttacttcgtgtcagcgtacgtccgttcccgaccgtaccgcccgtaccgtccgtacggtttccggggacgggggtaccgtaaggggtcggacggagtaggacggtaaccgaacgtggtcggcgtacgcacgtacgtctcgttcttacgtacttcccg

SEQ ID NO: 346185 - DNA, 533 bp, Homo sapiens
  misc_feature: GZ8MTXP02FTWPS.45.36.D03.1.454.CMB.2.raw
  modified_base (202)..(202): a, c, t, g, unknown or other
  misc_feature (202)..(202): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagacaccctctcctgcagggccagtaggagtgtcagtaagtacttaggctggaccaacagaaactggccaggcctcccaggctcctcatccatgatgcatcccaagacgggtcccctgggccgtcccagactacggttccgtggccagtgggtctggggacaggtgttcactctcaccgtnagcagctgacnctgatgtattgcttagtttacttctgtcagtcacgccgttccgccgtaccgccgcctcgtacgtttcggggcggggaccaggggtgagngagacgtaacgacgtgcgctacgcgacngtcgtntctacnctttcccg

SEQ ID NO: 346186 - DNA, 709 bp, Homo sapiens
  misc_feature: GZ8MTXP02JHMKQ.45.36.D03.1.454.CMB.2.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccagggganacagccaccctctcctgcgagggccagtaggagtgtcagtaagtacttaggctggtaccaagagaaacctggccaggcctcccgaggcctcctcatccatgatgcatcccaacgtcgggtccctggccgtccagacgtacggttccgnggccgaggtcggggtctaggggacaggtcgttcaccgttcgtaccgacccgtcgaacggtcccgtaacgggtcccgttacgggacggtacccgttagggtaacgtttagttaacggtttttcggaccgtttaacggtttttaccttcgtttacgttacgtacggtaccgtaacggttccccgttccccgtccccgaacccggtccccgtccttcccggtaaccgggtttccgggggacccggggggacccgtagggggtcggaaaggttacggtacggaaacggtaacggtaaacggtcggtaaccggtccgtacggtccgaacccgtgttccgtcgttacctttcctacgtttcccccg

SEQ ID NO: 346187 - DNA, 642 bp, Homo sapiens
  misc_feature: GZ8MTXP02IKP98.45.36.D03.1.454.CMB.2.raw
  modified_base (210)..(210): a, c, t, g, unknown or other
  misc_feature (210)..(210): n is a, c, g, or t
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctaggtaccaanagaaacctggaccaggcctcccaggctccncatccatgangcatccaacacgggtccctggccgtcccagacgtacggttccccgnggctaggtcggtctggggacnggtagttcacgttcctccaccgtcagcaagccctggacnccgtagatgttaatttgacttagtttacttcgtgttcaggtctacggtccgttcccgcccgtacggccctcgttaccgtaccggtttaccgggggaccgggggtaacccgtagggggtcgggtaaacggtacgttacgggaaacggtaccgggtaaaacggttggtacgggtaaccgtacgggaccgttaccgtaacgtttccgtttacggttacctttaaccg

SEQ ID NO: 346188 - DNA, 658 bp, Homo sapiens
  misc_feature: GZ8MTXP02IBE8S.45.36.D03.1.454.CMB.2.raw
  modified_base (204)..(204): a, c, t, g, unknown or other
  misc_feature (204)..(204): n is a, c, g, or t
  modified_base (505)..(505): a, c, t, g, unknown or other
  misc_feature (505)..(505): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggganacagccaccctctcctgcagggccagtaggagtgtcagtaagtactaggctaggtaccaacagaacctggaccaggcctacccgagcctcctcactccatgatcgacactacccaacgacggggtcccctgggcccgtacccaggtacctacggggttccgtggccaggggttcggggtctgggggaactaggtacgtttccacgttcaccgtaccgtcgacggcacgcccgtggacgccgtaggtactgttattttggacttaagttttctcgttgtcagtcacgttccgttcccgaccnccgtcccgtactcgtcgggtttccgggggaccgggggtaccgtagggggtcgaaggtacgttgggaaacgttaccggaacgttgggtacggctaccgggaacctaaccgtagtttacccgttacggtttccctttaacgtaccgtttcccccg

SEQ ID NO: 346189 - DNA, 728 bp, Homo sapiens
  misc_feature: GZ8MTXP02GYGXN.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacacgccaccctctcctgcagggccaggtaggagtgtcagtaagtacttaggctggtaaccaacagaaacctggaccaggcctcccaggctcctcactcccatgatgacactacccaaacgtacggggtcccctgggacccgtacccaggtaccgtacgggtttccggtggaccccgtagggtcggggttaccgtagggggaacctaaggtacgtttccaaccgtttccgtaccgtaacccgtcgaacggcacggtacccgtgggaacgtcccgtggtagttgttattttcgggactttaacggttttaccttcgttacggttactacggtcgtaacggttccgttccccggacccgtaccggtccccgtccttcccggttaccggtttccgggggaccggggggtaccgtagggggtacggtaacggtacggttaggaacggtaaccggtaacggttcggtacggtccgttacggaacccgaaccgtacgttccgttacgttccgttacctacgtttcccccg

SEQ ID NO: 346190 - DNA, 595 bp, Homo sapiens
  misc_feature: GZ8MTXP02F3CL7.45.36.D03.1.454.CMB.2.raw
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (388)..(388): a, c, t, g, unknown or other
  misc_feature (388)..(388): n is a, c, g, or t
  modified_base (437)..(437): a, c, t, g, unknown or other
  misc_feature (437)..(437): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccgccaggttccaggcaaggggctggagtgggtgccctnattccgaagntggaagtgagaagcctactcagactccgtgaaggccgcttcaccatctccagagacaattccaagaatgtcctctttttgactaaatgaaatagcctagagagttgaggacacgtctgtcttatttcngttgaccgagggggtacagtctaagtgagtctggttcgtagttgtaatntaaactactactacctacgatggacgtcgtaggggactaaacgggaccgtcggtacaccgtccgtccgactcggtaccttcccgaaccgaacgggtcccaacgtcccgttccttcccccgtggcccgaacccgtcgccctcgacgacgccgactccgg

SEQ ID NO: 346191 - DNA, 552 bp, Homo sapiens
  misc_feature: GZ8MTXP02GYXMW.45.36.D03.1.454.CMB.2.raw
  modified_base (335)..(335): a, c, t, g, unknown or other
  misc_feature (335)..(335): n is a, c, g, or t
  modified_base (492)..(492): a, c, t, g, unknown or other
  misc_feature (492)..(492): n is a, c, g, or t
tcagacgcgatcgacacgaccggtgctcgatttagctgcgtcacgatctctcttgggggggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggagtcgggggagcgttgtccagcctgggagtccctgagactctcctgtgcagcctctggattctccctcagtaactttggttccactgggtccgccaggttccaggcaaggggctggagtgggtcggccctnagtttccgaagtagtggaagtgagaacggcctatcagactccgtgacggggccgcttcgacctatcctccagacgactaaattaccaaagaactcgttaccttctttttagactaaatagaatagcctagagagttgaggacacgtctgtctattcngtgcgaggggacagtctagtgacgtctggttacgtaagtgtaatacactactactactac

SEQ ID NO: 346192 - DNA, 675 bp, Homo sapiens
  misc_feature: GZ8MTXP02HMKU3.45.36.D03.1.454.CMB.2.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcagggccagtaggagtgtcagtaagtacttaggctcggtaaccaacgagaaaccgtggaccaggcctccgaggctccncatcccatgatgcactccaacgacgggtcccctgggccgtacccgaaggaccgtacggggttcccgtgggcccgtacgggtcgggtacgtggggaacgaggtacgttcctaaccgttctaccgacccgttcgaacggccaacggcccgttgggacgtccgtggacttagggttacttttggactttaacgttttcttcgtacgttcgacgtcgtaccggtccgttccccgaccgtaccgtcccgtaccgttcccggtaccggtttcggggggacccggggggttaaccgtgggggttacggacgtaggtacggacggtacggtaacgtggcgggtctaggaacctacgtacgttcggtacgtcctacgtactttccccg

SEQ ID NO: 346193 - DNA, 707 bp, Homo sapiens
  misc_feature: GZ8MTXP02HL6RK.45.36.D03.1.454.CMB.2.raw
  modified_base (201)..(201): a, c, t, g, unknown or other
  misc_feature (201)..(201): n is a, c, g, or t
  modified_base (397)..(397): a, c, t, g, unknown or other
  misc_feature (397)..(397): n is a, c, g, or t
  modified_base (454)..(454): a, c, t, g, unknown or other
  misc_feature (454)..(454): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccacggaaaaattgtgttgacacagtctccaggcaccctgtctctgtctccgagggganacagccaccctctcctgcagggccaggtaggagtgtacaaggtaagttacgttaggcgtagggtaaccaaacgaacgaaaaccgtggacccgaaggccctaccccgaaggtcctaccctactactaccattcgatcgccaactacccgaaacgtacggggtcccctgggcctacccgaagaacgtacgggttccgnggacccgtagggtcggggtcctaggggactaggacgtttcaaccttctccgaccgtnaagcctacgccgtaggaccgtacctgggaacttgttacgtttttcgctttaacggttttaccttgtcgttacacggtacgttacggtcccgttacccgacccgtaccgtcccgtacgttccccgttaacggggtttccgggggaccgggggaaccgtaagggggttcggaagtacggttaggaaacgaccggtaaacgtggttacggcgttacgaaccgacctaagttcgtagttcccctagtaccttccccg

SEQ ID NO: 346194 - DNA, 808 bp, Homo sapiens
  misc_feature: GZ8MTXP02IM3CG.45.36.D03.1.454.CMB.2.raw
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccaggcaccctgtctctgtctccgagggggagacacgccaccctctcctgcagggccagtaggagtgtcagtaagtactaggctggtaccaanagaaacctggccaggctccaggctccncatccatgatcgcactacccaaagtacgggtcccctagggccgtaccccgaggaccgtacgggttacccggtggaccgtacggggttcggggtcgtgggggaactaacgggtcgtttcccgactttacccgtcccgtaaaccccgttccgaacgggccctaagggccccgttgggggacccgtacccttaggggtaacttacggttttaagttttttcggggaccctttaaggtttttaaccctttcccgtgtttaccggtaacgttccgtaaccgggtttcccggtttcccccggtacccaacccccggggcccgttaacccttccccggttaaccgggttttccccgggggggaccgggggggttaccccgaaaggggggtttagggaaccgggtaaacggttggggaaaaccggtaaacgggtaaaccgttgggggtaacggtaccggttcgtaaaccccgaaaccggtaactttcccggtaaggtttacccttttcccgaaacttttcccccgg

SEQ ID NO: 346195 - DNA, 533 bp, Homo sapiens
  misc_feature: GZ8MTXP02HNA0Q.45.36.D03.1.454.CMB.2.raw
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaaacgcggggtccccngggccgtcccagaccgaggttccgnggccctaggtgggtctggggacagtgttcactctcaccgtnagcagccgtgacgctgatgtatttgctagtttacttcgtgtcagcagtccgttccgccacgccgctcgacgttcgggcgggggaccgaggggtggagagtggacgacgaacgtgcgctgaacgaccatcgtgtccttctacttcc

SEQ ID NO: 346196 - DNA, 578 bp, Homo sapiens
  misc_feature: GZ8MTXP02I73Z5.45.36.D03.1.454.CMB.2.raw
  modified_base (294)..(294): a, c, t, g, unknown or other
  misc_feature (294)..(294): n is a, c, g, or t
  modified_base (405)..(405): a, c, t, g, unknown or other
  misc_feature (405)..(405): n is a, c, g, or t
  modified_base (512)..(512): a, c, t, g, unknown or other
  misc_feature (512)..(512): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtactaggctggtaaccaacagaaacctggccaggcctcccgaggcctccncatccatgatgacatacccaaacgcgggtcccctgggccctcccaggacctacggttccgtggccctaggtggggtctaggggacaggtacgttcgacctcgtacaccgtnaagcagcccgtggacgcgtagatgtatttcgacttagtttactcgtgtacgagtctacgtccgttacccgccgtaccgccgtctcgtacgttcggggcggggtacgngggtgagtgtaggacgtacgtacgtcggtcgcgtacgcgtacgtagtcgtcgtcttcgtacttccg

SEQ ID NO: 346197 - DNA, 668 bp, Homo sapiens
  misc_feature: GZ8MTXP02GEUDO.45.36.D03.1.454.CMB.2.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcgagggccaggtaggagtgtcagtaagtcttaggctaggtaccaanagaaacctgccaggctcccgagctccncatccatgatgacatacccaaagtcgggtcccctgggacccgtccgacgaaccgtggggttccccgtggaccccgtaggggttggggtcctagggggaacaggtacggtttccaccgttccgtaccgtacccggtacaacggtcccgaacggtcccgttaggggaaccgtcccgtaggtacgttacgttagtttcgactttaacgtttttcctcgtagtaccacggtctacggtccgttacccgcctaccggcccgtctcgttaccgggttcgggggaccgggggtacgagggggtcgaagtcgttagggaaacgtaacgtcggtgttcgggctacgccgaaccgtattcccgtgttcctccgtactttccccg

SEQ ID NO: 346198 - DNA, 625 bp, Homo sapiens
  misc_feature: GZ8MTXP02IJDIT.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccagtaggagtgtcagtaagtacttaggctggtaaccaacagaaacctggccaggcctccgaggcctcctcatccatgatgcatacccaacgtacggggtcccctgggcccgttacccaaggaccgtacgggttcccggtggccccgtaaggttcggggtctaggggaacaggtagtttcacgttctaccgaccgtcaagcacgacctgacgtccgtgatggttatttgtacttacgttttacttcgtcgttacgagtcgtacggtccgtttcccggcccgaccggtcccgtaccttcgtaccggtttccgggggaccgggggtaccgaggggtacggacgagtcggagaaccgaacggtgtacggcgtacgcgacctagtctacggttctctacttccccg

SEQ ID NO: 346199 - DNA, 535 bp, Homo sapiens
  misc_feature: GZ8MTXP02FOEB1.45.36.D03.1.454.CMB.2.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaaccaacagaaacctggccaggctcccagctccncatccatgatgcatccaaangggtcccctggccgtcccagacaggttccgtggccagtggtctggggacagagttcactctcacccgtnagcagctggacgctagatgtatttcgacttagtttacttctcgtacagctacgtccgttaccgccgacgccctcctactacgttcgggtcgggggacggagggtaggagagagacgacgaacgtacgtcgcgtgcgacactctcgtctctactcg

SEQ ID NO: 346200 - DNA, 648 bp, Homo sapiens
  misc_feature: GZ8MTXP02I360C.45.36.D03.1.454.CMB.2.raw
  modified_base (265)..(265): a, c, t, g, unknown or other
  misc_feature (265)..(265): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagcccaccctctcctgcagggccaggtaggagtgtcagtaagtacttaggctggtaaccaanagaaacctggccaggcctcccgaggcctcctcatccatgatcgaccatacccaagacggggtcccctgggccgtcccagaccgtacggttcccgtggcccctaggtggggtctaggggactaggtacgttccacttctaccgaccgtcgaacgcctacggcccgtagggactcccgtaggaattggttatttcggactttagtttactcgtgtaccgagcgtacggtccgttccccgaccgtacccggccgtcccgttacggtacccggtttcgggggaccgggggtaacctagggggtcgaagtacgttacggaccggtaaagtcggtacgcgtacggacctaacccgtgttctacgtccttacgtaccttcccgttacccg

SEQ ID NO: 346201 - DNA, 677 bp, Homo sapiens
  misc_feature: GZ8MTXP02IYPVK.45.36.D03.1.454.CMB.2.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcatcctgtctctgtctccaggggganacagcccacctctcctgcagggccagtaggagtgtcagtaagtacttaggctggtaaccaacagaaacctggaccaggcctcccgaggcctcctcatccatgatgacatccaaacgcgggtccctgggccgtccccgaagtaccgtacgggttccgtggccgtaggttggggtcggtaggggaacctaggtacgggtttcccaccgttcctacccgtacccgttacgacgcctaacggccgttagggacgtcccgtaggtacgttagttacgttttcgacgtttagtttacgttcgttgtacccgagtaccgtgtcccgttccgacccgtaccggtccgtcttccggtaccggtttccgggggaccgggggtaccgtagggggtacggaggacggttacggaacggaaaccggtacggttaggtcggtccgttgggacccctacgttacgttcgtacgtttaccttacttcccg

SEQ ID NO: 346202 - DNA, 656 bp, Homo sapiens
  misc_feature: GZ8MTXP02GSLU3.45.36.D03.1.454.CMB.2.raw
tcagacgcgatcgacacgaccggtgctcgatttagctgcgtcacgatctctcttggggagctctgggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtcggggggaggcgttgtccagccgtgggaggtccctgagactctcctgtgcagcctctggacttcctccctactagttaactttggtttcccacgtcgggtcccgccgtaggttccaggcgaaggggctgggagtggggtcggcctctagttccgaaagatcgggaagtcggaagaacggccctaactcagtaccgtaccggtggaaacggggtcccgtacttacgaaccctaactcctaccgaacgaacggaactaaacttacccgaaagtaaacttcggttcccttacgttttcgaactaaatagtaaactacgtacctaggaagtacgttggaagtacgtacgtcctagttacttactttctggtacgtaccgggaagggggtactagttacgtagtagtaacgttcgttaggttacgtagtacgtaacttactaaaacc

SEQ ID NO: 346203 - DNA, 564 bp, Homo sapiens
  misc_feature: GZ8MTXP02HK7Q4.45.36.D03.1.454.CMB.2.raw
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (485)..(485): a, c, t, g, unknown or other
  misc_feature (485)..(485): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggttccactgggtccgccaggttccaggcaaggggctggagtgggtgcctnatttcgaagntggaatgagaaggcctactcagactccgtgaaggccgcttcaccatctccagagacaattccaaanatgtccttcttttgctaaatgaaatagcctgagagttgagacacgtctgtctatttctagtcgtccgagggggacatctatgagtctggttgtagtagtaatacaacttactactactacaagtgaacgttgtagggacgtaaagggacccgtcggtaccncccggtactccgcacgtccttaccaccgacggtacccagtccgtcctccccgtgccgcctcgctcgagcgacacgtcgg

SEQ ID NO: 346204 - DNA, 567 bp, Homo sapiens
  misc_feature: GZ8MTXP02I5RKY.45.36.D03.1.454.CMB.2.raw
  modified_base (404)..(404): a, c, t, g, unknown or other
  misc_feature (404)..(404): n is a, c, g, or t
  modified_base (540)..(540): a, c, t, g, unknown or other
  misc_feature (540)..(540): n is a, c, g, or t
  modified_base (548)..(548): a, c, t, g, unknown or other
  misc_feature (548)..(548): n is a, c, g, or t
  modified_base (559)..(559): a, c, t, g, unknown or other
  misc_feature (559)..(559): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtcctccgaggggagacagccaccctctcctgcagggccaggtaggagtgtcagtaagtcttaggctaggtaaccaacagaaacctggaccaaggctcccgaggcctcctcactccaatcgatgcataccaagagggtcccctggccgtcccagacctaggttccgtggacccgtagggtcggtctaggggacaaggacgttcactctcgaccgtnaacgcagccctggacgccctagattgattttgcttagtttactctgtcagtacacggtcgttcccgccaacgcccgcttcaccgtttcggggcgggggaccaggggtgacgagtgacggacgaacgttgacggtcnggaacacncgtatgtcctnacttcccg

SEQ ID NO: 346205 - DNA, 640 bp, Homo sapiens
  misc_feature: GZ8MTXP02GAERW.45.36.D03.1.454.CMB.2.raw
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (418)..(418): a, c, t, g, unknown or other
  misc_feature (418)..(418): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccacccctctcctgcagggccagtaggagtgtcagtaagtacttaggctggtaccaacngaaacctggccaggcctcccgagctcctnatccatgatgacataccaagacggggtcccctagggcccgtacccgagaccgtacgggttcccggtaggccccgtagggtggggtacgtcggggaacaggtcgttcaccttcgtaccacccggtnaagccaggtcccgtggacgtcccgtagtagttgtattttcggaccttaaggttttacttcgtggttaccaacgtcgtacggtccgttcccgaccgaccgcccgtcttacccgtcggtttccgggggcgggggtaaccggtagggggtggacggtaggtaggaacggtaacgtaacgtcggtcgggactcggaacgacctagtccttgtcttctacgttcccg

SEQ ID NO: 346206 - DNA, 566 bp, Homo sapiens
  misc_feature: GZ8MTXP02I9KY7.45.36.D03.1.454.CMB.2.raw
  modified_base (214)..(214): a, c, t, g, unknown or other
  misc_feature (214)..(214): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
  modified_base (557)..(557): a, c, t, g, unknown or other
  misc_feature (557)..(557): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccnccaggttccaggcaaggggctgggagtgggtcggccctctatttccgaagatggaagtgagaaggcctatcagactccgtgaaggccgcttcaccatctccagagacaaattcccaagaatcgtccttctttttgactaaatgtaatagcctgagagttgaganacgtctgtctnttntgtgcgaggggtnatctatgagtnttggttactagtagtaatcaacttactactactcatggacgtcgtagggacaaaggaccgtcggtcaccgttctaccgcacgtctaccacaacggtcccagtccggtccttccccgtcgccgaacctcgactccgaggacncgacctcgg

SEQ ID NO: 346207 - DNA, 628 bp, Homo sapiens
  misc_feature: GZ8MTXP02JX9AZ.45.36.D03.1.454.CMB.2.raw
  modified_base (206)..(206): a, c, t, g, unknown or other
  misc_feature (206)..(206): n is a, c, g, or t
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (466)..(466): a, c, t, g, unknown or other
  misc_feature (466)..(466): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaaccggaaaaattgtgttgacacagtctccaggccaccctgtctctgtctccgagggganacagcccaccctctcctgcgagggccaggtaggagtgtacagtaagtactaggctggtacaacagaaacctggccaggcctcccgaggcctcctcactccatgatgcataccgaacgtcggggtcccctgggccgtcccagtaccgaggttccgnggccctagggtgggtcgtggggacaggnttcacgtcnccaccgtnacggcacggccgtgggactccgtaggacttggttattttcgacttttagtttaccttcgngttccagccgtcggtccgttcccggaccctaccggtcccgtccttcggtaccgggtttccgggggccgggggtaccgagggggttggaacggtagtcggaacgtacggtacgtgggtcgactacggaacctaccgtgttactcgttacctctaccgttcccg

SEQ ID NO: 346208 - DNA, 695 bp, Homo sapiens
  misc_feature: GZ8MTXP02H7137.45.36.D03.1.454.CMB.2.raw
  modified_base (200)..(200): a, c, t, g, unknown or other
  misc_feature (200)..(200): n is a, c, g, or t
  modified_base (282)..(282): a, c, t, g, unknown or other
  misc_feature (282)..(282): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaacggaaaaattgtgttgacacagtctccaggcaccctgtctctgtctccgaggganacacgccaccctctcctgcgagggccaggtaggagtgtcaagtaagtacgttaggctacggtaaccaaacgacgtaaaccgnggacccgaacggccctacccgaggcctcctcactccatcgatcgacactacccaacgacgggtccctagggccgtacccgaagaccgtacgggttcccgtggacccgtagggttcgggtcgtaggggacaggacgttccacgttctccaccgtnacggcacgccctgggacncctggactgttagttttcgacttagtttacttcgtagttacgcgtactaggtcccgttacgcccgtaccgtcccgtccttaccggtcccggtttcggggggacccgggggtaccggtacgggggtacggaacggtaggtacgggaaacgtaacccgggtaacgtttgggaccgggtccttacggggaaccctaaaccgtacggtttcctcggtttacccttccggttactttcccccccgg

SEQ ID NO: 346209 - DNA, 557 bp, Homo sapiens
  misc_feature: GZ8MTXP02IM74V.45.36.D03.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (385)..(385): a, c, t, g, unknown or other
  misc_feature (385)..(385): n is a, c, g, or t
  modified_base (524)..(524): a, c, t, g, unknown or other
  misc_feature (524)..(524): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacgagaaacctggccaggctcccaggctccnatccatcgatgcatccaacgagggtcccctgggcctcccagactacgggtcgtggccctaggtgggtctaggggacaggtacgttcacgttcncgtaccgtcaggtcagccgtgacgctgatgtatttgacttagtttacttgtgttcagctacgtcgttcccgccaccgccgtctcgtacgttcggggcgggggtaccgaggggtcgagagtggacgacgacgttgacggntcgctaccgtactcgtcgtctttcactttcccg

SEQ ID NO: 346210 - DNA, 636 bp, Homo sapiens
  misc_feature: GZ8MTXP02JAEA8.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagcccaccctctcctgcgagggccagtaggagtgtcagtaagtacttaggctggtaccaacagaaacctggccaggcctcccaggcctccctcactcccatgatgcactcccaacgacggggtcccctgggcccgtcccaggaccgtacgggttccggtcggcccgtaggtcggggtctaggggacaggtacgttcactccgtccgacccgtcgagccgacgcccgtggaccgcctagattggttatttcggactttagttttacctgtgttaccgagtccgtacgtccgttcccgacccgtaccgcccgtctaccggtccgggtttaccgggggccgggggtaaccgtgggggtacgaggtacgtacggaacggtaacgacgttggtacggcttacggaaccactacgtcgtcgtctttcgactttccccg

SEQ ID NO: 346211 - DNA, 569 bp, Homo sapiens
  misc_feature: GZ8MTXP02JSZY1.45.36.D03.1.454.CMB.2.raw
  modified_base (201)..(201): a, c, t, g, unknown or other
  misc_feature (201)..(201): n is a, c, g, or t
  modified_base (320)..(320): a, c, t, g, unknown or other
  misc_feature (320)..(320): n is a, c, g, or t
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggctcccaggcctcctcatccatgatgcatccaacgcgggtcccngggcctcccagacgaggttcccgnggccctaggtgggtctggggacaggagttcactctcaccgtnagcacgcctggacnccgtgactgtattttgacttagtttacttctgtacagcacgtcgtccgccgtacgccgtctccgtacggtttccggggacgggggtaccgtaggggtcggtagacgtcggaacggacgtaacgtgtcgggctggaacctacgtacttcgtcgtcttacgactttccccg

SEQ ID NO: 346212 - DNA, 718 bp, Homo sapiens
  misc_feature: GZ8MTXP02I89K1.45.36.D03.1.454.CMB.2.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (458)..(458): a, c, t, g, unknown or other
  misc_feature (458)..(458): n is a, c, g, or t
tcagacgcgatcgacacgaccggtgctcgatttagctgcgtcacgatctcacgtgggggaggaactgctcagttaggacccagagggaaccatggaagccccagctcagcttctcttcctcctgctactctggctcccagataaccaccggaaaaattgtgttgacacagtctccaggcaccctgtctcctgtctccaggggagaccagcccaccctctcctgcagggccagtaggagtgtacagtatacttaggctggtaccaanagccngccagccnccagctcctcatccatgatcgacntaccaacggccggtccctgggtaccctcccggaacgtaccgtacgggttcccggnggtaccccgtaggggtcggtacgtacggggactagggttacttccaccgttccgacccgtaccgtacacggtaccgccgtccgtggggaaccttcggttnatttcggtacgaacgtttcggtccgtacgtttaccgtttaccgttcggttaccgtacggttcccgtaccggacccggacccgttcccgtcccgtacccggttcccggtcccggggtacccggtaccggggttaccgggggtaccgggggaaccggtacggggtacgggtacgggtaacggtacgggtacgggtaccggtacgttaccggtcggtccgtccggtaccgaccttaccgtccgtaccgtttaccgtttacccg

SEQ ID NO: 346213 - DNA, 539 bp, Homo sapiens
  misc_feature: GZ8MTXP02FKCY9.45.36.D03.1.454.CMB.2.raw
  modified_base (386)..(386): a, c, t, g, unknown or other
  misc_feature (386)..(386): n is a, c, g, or t
  modified_base (481)..(481): a, c, t, g, unknown or other
  misc_feature (481)..(481): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggcctcccgaggcctcctcatccatgatgcatcccaacgcgggtcccctgggcctcccgagacaggttccgtggccaggtgggctggggacaggagttcactctcaccgtnagcagctggacgcctgatgtatttgcttagtttacttctgtcagctacggtccgttcccgccacgcccgctcgtacgttcggggcgggggaccgnggggtggagagtggagacggaacgtgtcggctgcgacactcgtgttctctacttcccg

SEQ ID NO: 346214 - DNA, 579 bp, Homo sapiens
  misc_feature: GZ8MTXP02F5B45.45.36.D03.1.454.CMB.2.raw
  modified_base (249)..(249): a, c, t, g, unknown or other
  misc_feature (249)..(249): n is a, c, g, or t
  modified_base (387)..(387): a, c, t, g, unknown or other
  misc_feature (387)..(387): n is a, c, g, or t
  modified_base (452)..(452): a, c, t, g, unknown or other
  misc_feature (452)..(452): n is a, c, g, or t
  modified_base (492)..(492): a, c, t, g, unknown or other
  misc_feature (492)..(492): n is a, c, g, or t
  modified_base (537)..(537): a, c, t, g, unknown or other
  misc_feature (537)..(537): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccgccaggttccaggcaaggggctggagtgggtgccctnatttccgaagatggaagtgagaaggcctactcagactccgtgaaggccgcttcaccatctccagagacaattccaagaatgtccttcttttgactaaatgaaatagcctagagagttgagacacgtctgtctatttcngttgacccgagggggacagtctatgtagtctggttcgtagttagtaatacaactactactacctnatggacgtcgtgggacaaaggacctcggtcacgtctccgnacgcttaccaccgtaaacggcccacgtccggtcccttacccccgnggccctccccgtgcccgtaccgaggtaccgccaccgtccggg

SEQ ID NO: 346215 - DNA, 680 bp, Homo sapiens
  misc_feature: GZ8MTXP02JS24M.45.36.D03.1.454.CMB.2.raw
  modified_base (201)..(201): a, c, t, g, unknown or other
  misc_feature (201)..(201): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccaggtaggagtgtacagtaagtacttaggctggtaccaacgtagaaaccgtggccaggcctacccgaggcctcctcatcccatcgatgaccatcccgaaagtacggggtcccctgggccgtcccgaagaccgtaggtttcccggnggcccgtagggtcgggtcgtacgggacaggtacgttccacgttctaccgaccgtcgacgacgacgtccgtggacgtcgtagtacttgttagttttcgactttacgtttacttcgtgtacgacgtcgtaccgttccgtcccgacccgtaccgtcccgtccgttaccggttaccgggttccgggggaccgggggtacgtacgggggtaggaacggtacgtacgggaaacggtacggtaacggttcgggtaccggtcgtaccggaaccgtacccgttacgttaccgttacgtttacccttccgttaccttcccg

SEQ ID NO: 346216 - DNA, 601 bp, Homo sapiens
  misc_feature: GZ8MTXP02HSBTS.45.36.D03.1.454.CMB.2.raw
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (391)..(391): a, c, t, g, unknown or other
  misc_feature (391)..(391): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggaccaggctcccaggctcctcatccatgatgcatccaanacgggtcccctggccgtcccagactaggttccgnggccaggtgggctggggactaggacgttcacgtctaccacccgttnacgtcacgcccgtggacgcctgactgtatttggcttagtttacttctgtcagtcagtccgttccgcctaccggcccgtcctccgtaccgtttccggggaccgggggtaccgacgggggttcgggacggtaggttacggacggtacggtaaaccgtgggtcgggcgtcggaacctaccggtacttccgtcggttcctttctacgtttcccg

SEQ ID NO: 346217 - DNA, 656 bp, Homo sapiens
  misc_feature: GZ8MTXP02GOY8P.45.36.D03.1.454.CMB.2.raw
  modified_base (212)..(212): a, c, t, g, unknown or other
  misc_feature (212)..(212): n is a, c, g, or t
  modified_base (276)..(276): a, c, t, g, unknown or other
  misc_feature (276)..(276): n is a, c, g, or t
tcagacgcgatcgacacgaccggtgctcgatttagctgcgtcacgatctctcttgggggccctggggaggaactgctcagttaggacccagagggaaccatggaagcccccagctcagcttctcttcctcctgctactctggctcccagataccaccggaaaaattgtgttgacacagtctccaggcaccctgtctctgtctccgagggganacagccaccctctcctgcgagggccagtaggagtgtacagtaagtacttaggctaggtaccaanagaaacctggccaggctcccgaggcctcctcatccatgatcgacactccaacgacgggtcccctggccgtacccaggaccgtaggttccccgtggctaggttcggggtctacggggacaggtacgttcaaccgttcctccgtaaccgtcaacggcacgtcccgtgggacgtccgtagtagttggttaatttttcggacttaggttttaccttcgttagtcgaacggtccgtacggttcccggtttcccgccctaacccgggtcccgtcgttaccgtaccgggtttccgggggaccggggggtacctagggggtacgaggtacgtacggaaggtacccgtagtcggtacggtgtcggacctaccgtgtcgttcgttctacg

SEQ ID NO: 346218 - DNA, 767 bp, Homo sapiens
  misc_feature: GZ8MTXP02G4CSA.45.36.D03.1.454.CMB.2.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtcctccagggganacagccacctctcctgcagggccagtaggagtgtcagtaagtacttaggctggtaccaanagaaacctggccaggcctcccgaggctcctcatccatnatgccatacccaagtcggtcccctgggcctccaaggaccgtagggttcccggtaggcccgtacgggttcggggtcgtaggggaactaggtacgtttccaaccgttcttacccgacccgttcgaacgccgaaacggtcccgttaggggaccgtacccgtagggtaacttcggggtttaattttttacgggttaacgtttttaacccgtttcgtacggttaccgtaacgtccgtaaacgggttcccggtttacccggaccccgttaccgggtccccgtaccgtcccgttaacccgggtttccgggggaccgggggtttacgaaccccggggtagggggttacggaaggtaacggttacggggaaacgggttaaaccgaaaccggtttcggggtacggcccgttacggtaacccaaacccggttacgttctttaacgggtttccctttacggtaaccgttttccccccg

SEQ ID NO: 346219 - DNA, 761 bp, Homo sapiens
  misc_feature: GZ8MTXP02ITK1D.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaagggagacagcccaccctctcctgcagggccaggtaggagtgtcagtaagtacttaggctaggtaccaacagaaacctggccaggcctcccaggctcctcatccatgatgacatacccaaacgtacgggtcccctagggcccgtacccaggaccgtagggttccccggtgggcccctagggtcggggtccgtagggggaacctaggtacgttccgtaaccttcgtacccgacccgttacgacgccgtaacggcccgttagggaaccgtcccgttagggaactttcggttaattttttcgggaccttttaaacggtttttaccctttcgttacgtttaccgaacggttcccgtaacgggtttccccgtttacccggccccgacccggtccccgtccgtttaccggtaccgggtttccgggggacccgggggggaacccgtaggggggtacggtaaggtaacgggttacggaaacggtaaacccggggtaaacgttcggggaacggttccgtggaacccctaaacggtactttcggttacgttcccgtttacgtaccctttcccccgg

SEQ ID NO: 346220 - DNA, 673 bp, Homo sapiens
  misc_feature: GZ8MTXP02HK6MQ.45.36.D03.1.454.CMB.2.raw
  modified_base (211)..(211): a, c, t, g, unknown or other
  misc_feature (211)..(211): n is a, c, g, or t
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtagtacttaggctggtaccaacagaacctggaccaggcctcccgaggcctccctacactccatcgatcgactactccgaaacgcgggttcccnggccgtaccgagacgtacggttcccgnggcaggtcgggtctgggacnggacgtttcacgttcaccgaccgtcgacgtccacggtcccgtaggggaccgtcccgttagtactttcggttaatttttcggacccgttagtttttactcgttaggttacctagggtccctaggtcccccgttaccgcccgtacccgtccggtccttcgggttaccggtttcggggggacccgggggttaccgagggggtacggacggtagtacgggaaccggtacgggtaacgttcgggtcggtaacctcggacctaccgagtttcccgtcgtttacctttccg

SEQ ID NO: 346221 - DNA, 635 bp, Homo sapiens
  misc_feature: GZ8MTXP02HP8CE.45.36.D03.1.454.CMB.2.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (353)..(353): a, c, t, g, unknown or other
  misc_feature (353)..(353): n is a, c, g, or t
  modified_base (421)..(421): a, c, t, g, unknown or other
  misc_feature (421)..(421): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaanagaaaccnggccagctcccaggctctcatccatgatgcatccaacgtaggggtcccctagggccgttacccagaaccgtagggttcccggnggaccgtagggtcgggtcgtagggacaggtacgttccacttcaccgaccgtcacgcacgcctaggacnccgtgtagtgttactttgacgttacgtttacttcgtgtctacgtcgtacgtccgttcccgccgaccgcccgtctaccgtaccggtttccgggggaccgggggtaccggtaggggtacggtacggtacggtacggaacggtaacggtaacggtacgggtcggtacgtacggaaccgaaccgtacgttcgtacggtttccgttactaccgttcccg

SEQ ID NO: 346222 - DNA, 815 bp, Homo sapiens
  misc_feature: GZ8MTXP02FYFG3.45.36.D03.1.454.CMB.2.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacacgcccaccctctcctgcgagggccaggtaggagtgtcagtaagtacttaggctaggtaaccaacagaaaccgtggaccaggcctcccgaggcctaccncactccatgatgacactacccaaacgcggggtccctcgggccgtacccgaggaccgtacgggttccgnggaccgtagggtcgggtacgtaggggactaggtacgtttccgacttcgtaccgacccgtcgacgccgtacggtcccgttaggggaaccgtcccgttaggtacgtttagggtttaacgtttttcgggtaacctttttaacgggttttttaccttccggtttacggtttaaccggaacggttacccggttaacccggtttacccgggtttccccccgggacccggtaaccccggtcccccggtttaccggtttaccccggttaacccgggggttttcccgggggggaacccgggggggtaaaccccggttagggggggttaacccggaaaggggtttaccgggtaagggaaacggggtaaaccgtaaacggttgggtacgggtaaccgtcggaaccccgtacgtaacgttccgttacggtttacctttcaaccggttttcccccg

SEQ ID NO: 346223 - DNA, 601 bp, Homo sapiens
  misc_feature: GZ8MTXP02I5X0E.45.36.D03.1.454.CMB.2.raw
  modified_base (279)..(279): a, c, t, g, unknown or other
  misc_feature (279)..(279): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (490)..(490): a, c, t, g, unknown or other
  misc_feature (490)..(490): n is a, c, g, or t
tcagacgcgatcgacacgaccggtgctcgatttagctgcgtcacgatctctcttgggggacctggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacacgccaccctctcctgcacgggccaggtaggagtgtcaggtaagtacgttaggctaggtaaccaanagaacctggccaggcctcccgaggcctcctacactccatgatgacactaccaacgcgggtccctggcctacccgagactaggttccccgnggcgaggtcgggtctggggacnggtacgttccacttcnccgaccgtcaacgcacgtccgtgggacgtcctagacttgtatttcgcttagtttcttctgtcaggtctacgtccgtccgaccncgccgtcctcgtaccggttcgggggacgggggacgtcggggtggaggtcgtaggaacgacggaacgttcgggtacggcgtcggacctacgtacgttcgtcgttaccttacg

SEQ ID NO: 346224 - DNA, 621 bp, Homo sapiens
  misc_feature: GZ8MTXP02F4ZXJ.45.36.D03.1.454.CMB.2.raw
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcgagggccaggtaggagtgtcagtaagtacttaggctaggtacaacagaaacctggccaggcctcccgaggcctcctcactccatgatgcatccaacgacgggtccctggcctccagtactacggttccccgnggcgaggtcgggtctggggaacngtacgttcactcctaccgaccgtcacgccagcccgtggacgccgtgatcgtatttcgcttagtttcttgttcgtcagtcgaggttccgttccgcccgaccggcccgtcgttccgtaccgggtttccgggggaccgggggtaaccggtacgggggtcgggaacggtaggtacggaaacggtaacggtaacgtcgggtggtaaccgtcggacctaccgtattccgtcgttacctttccg

SEQ ID NO: 346225 - DNA, 814 bp, Homo sapiens
  misc_feature: GZ8MTXP02GKUDJ.45.36.D03.1.454.CMB.2.raw
tcagacgcgatcgacacgaccggtgctcgatttagctgcgtcacgatctctcttgggggggagacgagcccagcactggaagtcgccggtgtttccttcggtgatcatcactgaacacagaggactcaccatggactttgggctgacctgggttttcctcgttgctcttttaagaggtgtccagtgtcaggtgcaggtggtggaggtcggggggagtcgttgtccagccgtgggaggtccctgagctctcctgtgcagcctcgtggtacttcctccctctagttaactttcggttcccagtcgggtcccgcgtaggttccaggacgaagggggtctaggggaggttcggggtcggtccccttgtacgttttacccggaagtagtaggggaaagttggaaggaaccggccctaacgtcgaagtacccgtcccggttagggaccgggggtccctaccgttaccaacccgtactacccgttaccgaaacggaacgtaaacctaaacttcccgaaaaggtaacttaccggtttaccctttacttttttaacggaaaccttaaaagttaggtaaacgttaaacggtcccgttaaggtaacgggttaaggtttacgggaaacggggtaaccttaaccgggttccttaggtttacccttaagttttccgtcggttacggacccgggtaagggggtacccttaagttaccgttaacggtaggttaacggttacccggttcgggttttaacggttaacgggtttaaagttaaacgttaaccgttaaaaccgtttacctttaaaccctttaaccgttaaaccgg

SEQ ID NO: 346226 - DNA, 671 bp, Homo sapiens
  misc_feature: GZ8MTXP02F4MOU.45.36.D03.1.454.CMB.2.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcagtaagtacttaggctaggtaccaacagaaacctggaccagcctcccgaggcctccncactccatgatcgacatcccaaacgacgggttcccctagggcccgtaccccgaggtaccgtacggggtttcccggtggcccgtagggtcggggtactggggaccaggtagtttccaccgttctccgtaacccggtnacggcacgccgtaggacgtcgtagtagttagttntttcgtacttagtttacttcgttcgtactacgacgtcgtcccgttcccgcccgtaccgtcccgtccgttaccggttaccgggtttccgggggaccgggggtaccggtagggggtaggtaacggtaggtacggaacggtaacggtaacggtcggtacggtacgtacgaaccgtacctacgtcttcgtacttaccgtacgtttcccg

SEQ ID NO: 346227 - DNA, 708 bp, Homo sapiens
  misc_feature: GZ8MTXP02HZDDB.45.36.D03.1.454.CMB.2.raw
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctaggtaaccaacaaggaaaccctggaccctaggcctcccaggcctccgcactccaatcgatgcatccaaacgtcgggtccctaggcctacccagtaaccaggtttcccggnggaccgtaggttcgggtacgtagggtaactaggttacgtccgtaccgtcctaccgtaccgtacacgacgtaccgtccgtaggaccgtcgtagtacgttagttacgtttcgactttaacgtttaccttcgttacgacgtacgtaccgtacgttcccgttaccccgacccgtacccgtccgtacccgttaccggttacccgggtttaccgggggacccggggttaaccggaggggtacggtaacggtacggttaacgggaaacgtaccggtacggtacggtcggtaccgtacgaaccgtacggttacgttcccgttaggttccccttaccgttaccgttccccg

SEQ ID NO: 346228 - DNA, 673 bp, Homo sapiens
  misc_feature: GZ8MTXP02JAI5P.45.36.D03.1.454.CMB.2.raw
  modified_base (187)..(187): a, c, t, g, unknown or other
  misc_feature (187)..(187): n is a, c, g, or t
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctnagttaactttggtttccacgtgggtccncaggttccaggcaaggggctggagtgggtcgccctnatttccgaagngtggaagtgagaacggcctactcagactccgtgaagggccgcttcaccatctccagagacattccaagaatgtcctcttttgcaaatgaatagcctagagagttagagacacgtctgttctatttctgtcgccgagggggtacagtctagtgtagtcgtggttcgtagtataagtactaactactaacgtaccttacgaagttgggtacgttacggtacggggtaaccgtaaaacggggtcccttacggggttacctaacccggtctcccggtacgtacggtcccttacccgaaccggtaaccggtacccccgtaagttccccgggttacccctttcccccggcgggggtccccctcccccgtttacggccccttaccggacggggtaccccgtaccgttacccggtccgg

SEQ ID NO: 346229 - DNA, 574 bp, Homo sapiens
  misc_feature: GZ8MTXP02JESLK.45.36.D03.1.454.CMB.2.raw
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (544)..(544): a, c, t, g, unknown or other
  misc_feature (544)..(544): n is a, c, g, or t
  modified_base (554)..(554): a, c, t, g, unknown or other
  misc_feature (554)..(554): n is a, c, g, or t
  modified_base (566)..(566): a, c, t, g, unknown or other
  misc_feature (566)..(566): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtccnccaggttccaggcaagggggctggagtgggtgccctcattccgaagntggaagtgagaggcctactcagactccgtgaaggccgcttcaccatctccagagacaattccaagaatgtcctcttttgctaaatgaatagcctgagagttgagacacgtctgtctnttctgtgtccgagggggtacatctatgtacgtntggtacgtagtgtaactcaactactactactacatggcgtcgtaggggacgaaacgggccttacggtccaaccggtcctccgccgacgtccttacccaccgtaacggcccacgtccgtccttccccctcggccncccgtcgccncgaacgccgacncctccggg

SEQ ID NO: 346230 - DNA, 741 bp, Homo sapiens
  misc_feature: GZ8MTXP02HZ9YO.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaaattgtgttgacacagtctccaggcaccctgtctctgtctccgaggggagacacgccaccctctcctgcgagggccaggtaggagtgtacgagtaagtacgttaggctaggtaccaacgaagaaacctggaccgaaggcctacccgaacggccttccctcgaacttacccagtgaactcgaccaactacccaaacggtaccgggttaccccgtgggcccgtacccgaacggaccgtacgggttccggtggtcccgtagggttcggggtcgtaggggaacctaggtacgtttccgaccgttaccgtacccgaccgttacgaacggacctacgggtcccgttaagggaccgtccgttaggtaacgttacggttttaaactttttcgggaactttaaacgggtttttactttccgtaggttaaccgtagtccgttaacggtcccgtttccccgaccggtacccgtcccgtcgttacccgttaccggggttcgggggaccgggggacgtacgggggtgaacgaggtacggacggtaaaccgtaggtcgtacggctacgaacctacgagtcgttacgttcctacgtactccccg

SEQ ID NO: 346231 - DNA, 507 bp, Homo sapiens
  misc_feature: GZ8MTXP02H4U0P.45.36.D03.1.454.CMB.2.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (415)..(415): a, c, t, g, unknown or other
  misc_feature (415)..(415): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcacccctgtctctgtctccaggggganacagccaccctctcctgcagggccagtaggagtgtcagtaagtacttaggctggtacaacagaaacctggccaggctcccaggctcctnatccatgatgcatccaanacgggtccctgggcctccagacaggtcctggccaggtgggtcnggggcaggacttcactctcacgtnagcanccgngncnatgtatttnctattattntntnncngtcgtcgcacgcgctctcgtcgggcggggacggaggaggagagagacgacgaacgtacgtcgcgacgcgacactctacgtacttactactcc

SEQ ID NO: 346232 - DNA, 679 bp, Homo sapiens
  misc_feature: GZ8MTXP02H7L9G.45.36.D03.1.454.CMB.2.raw
  modified_base (204)..(204): a, c, t, g, unknown or other
  misc_feature (204)..(204): n is a, c, g, or t
  modified_base (359)..(359): a, c, t, g, unknown or other
  misc_feature (359)..(359): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaaccggaaaaattgtgttgacacagtctccaggcaccctgtctctgtctcgagggganacagcccaccctctcctgcagggccagtaggagtgcagtaagtacttaggctaggtaccaaacagaaacctggaccaggcctacccaggctcctcatccatgatgacataccaacgacgggtccctgggcctcccaaggacctaggggttcccgnggacccgtagggtgggtcgtagggactaggtacgttccacgttccaccgtaccgtcgacgccacggtccgtaggacgtcgtagagttgtttacgtttcgactttaacgtttccttcgttacgtcgtacgtcgtacgttccgtcccgacccgtaccgtcccgtcgttacccggtaccgggtttccgggggaccgggggtaccgtaagggggtcggaacggtacggttagggaaacgtaccggtaacggttcggtacggtacgtacggtaacctaccgttaagtcccgtttacggtttaccgtttaccgttaccgttccccg

SEQ ID NO: 346233 - DNA, 633 bp, Homo sapiens
  misc_feature: GZ8MTXP02FLFYA.45.36.D03.1.454.CMB.2.raw
  modified_base (329)..(329): a, c, t, g, unknown or other
  misc_feature (329)..(329): n is a, c, g, or t
  modified_base (405)..(405): a, c, t, g, unknown or other
  misc_feature (405)..(405): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagccaccctctcctgcgagggccagtaggagtgtcagtaagtcttaggctggtaaccaacagaaacctggccaggcctcccgaggcctcctcatccatgatgcactcccaaacgcgggtcccngggcctcccagtaccgaggttccgtggcctagggttgggctaggggacaggtacgttcacctcgtacctacccgtnaacggtccacggcccgtgggacgtccgtgtattgttattttcgactttacgtttacttcgtgtacacggtacacggtccgttcccgaccaccggtccccgcgttaccgtaccggggtttcggggaccggggggtaacgtgggggtagaacgtacggtaggaacggacgtaacggttggacggcctggaaccgaccttgtccgttagtccttacgtaccgtttcccccg

SEQ ID NO: 346234 - DNA, 673 bp, Homo sapiens
  misc_feature: GZ8MTXP02GXQ3H.45.36.D03.1.454.CMB.2.raw
  modified_base (201)..(201): a, c, t, g, unknown or other
  misc_feature (201)..(201): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggganacagcccaccctctcctgcagggccagtaggagtgtcagtaagtacttaggctaggtaccaacagaaacctggaccaggcctcccaggtcctcctcatcccatgatgacactacccgaaacgtcggggtcccctagggtcccgtacccgaggtaaccgtcgggttacccggtgggacccgtaggggtcggggttcgtacggggacgtaacggtacgttccgaaccttcgtaccgacccgttcaaggtcccgaacgggtccctaggggaacccgtccgtagggtacttaggttaattttccggactttaacggttttccctgtcgttacgacgtctacggtccgtcccgaccgaccgcccgtactccgtacgggttccggggacggggtacgtggggtacggagacgtggaacgtacgacgttcgggacgtcgtacgaacctacgtcgtcgttgtccttatacccgtttcccg

SEQ ID NO: 346235 - DNA, 626 bp, Homo sapiens
  misc_feature: GZ8MTXP02G3J1F.45.36.D03.1.454.CMB.2.raw
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
  modified_base (550)..(550): a, c, t, g, unknown or other
  misc_feature (550)..(550): n is a, c, g, or t
  modified_base (604)..(604): a, c, t, g, unknown or other
  misc_feature (604)..(604): n is a, c, g, or t
tcagacgcgatcgacacgaccggtgctcgatttagctgcgtcacgatctctcttgggggccctggggaggaactgctcagttaggacccagagggaaccatggaagcccccagctcagcttctcttcctcctgctactctggctcccagataccaccggaaaaattgtgttgacacagtctccagcccaccctgtctctgtcctccgagggganacagcccaccccctcctgcaggccagtaggagtgtcagtaagtacttaggctggtacaananaactgcaggctccaggctcctnactccatgatgcatccaacgtacggtccccgtggaccgtccccaggacctacgggtttccgtaggccgtaggttcggggtcgtggggaaccaggtacggttcactccgtccaccgtcagtccgacgaccgtggacgccgtagattagtagtttcgtacgttagttttactcgttagtccgtaagcgtacggtcccgttacccgcccaccggccgtccgtaccgtccggtttccggggcgggggtaaccgggngggtacggaggtgacggacggtacgtacgtcggtcgtacgtaacgctaaccgtntccgttcttaccgttcctaccg

SEQ ID NO: 346236 - DNA, 748 bp, Homo sapiens
  misc_feature: GZ8MTXP02HR0AK.45.36.D03.1.454.CMB.2.raw
  modified_base (410)..(410): a, c, t, g, unknown or other
  misc_feature (410)..(410): n is a, c, g, or t
  modified_base (480)..(480): a, c, t, g, unknown or other
  misc_feature (480)..(480): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccaggtaggagtgtcaagtaagttacttaggcttacggtaacaaacacggaaaccgtggacctaaggcctacccgaggtcctccctacactcccaagttgaaacttcgacctaactaccccgaaacgtaccggggtcccctaggggccccgttaaccaaaggtaccgtacggggtttccccggngggtacccgtaggggttcgggtacgtacgggacgtacggttacgttccaaccgttcctaccgtacccgtnacggtaccacggtccgtacggacgtcgtagtagttgtttacgtttcgtactttacgtttacttcgtgtacacgtcgtaccgtccgtacccgaccgaccgtccgtcgttaccggtaccggggttccgggggaccggggtacggtaggggtacggaacggtacggtaagggtaaaccggtaccgggtaaacggttcgggtaccggtaccgtcggtaacccgtacgttaccgtttcgttaccggtttcctttacccgtttacccgtccccg

SEQ ID NO: 346237 - DNA, 720 bp, Homo sapiens
  misc_feature: GZ8MTXP02FY66P.45.36.D03.1.454.CMB.2.raw
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggcaccctgtctctgtctccgaggggagacagccaccctctcctgcgagggccaggtaggagtgtcagtaagtacgttaggctggtaccaanagaaacctggccaggctcccaggctccncatccatgatgcatccaanacgggtccctaggccgtccagacgtacggttccccgtggcctagggtcgggtctaggggaccaggtcgttccaacttcctaccgacccggtcaacgtccgtaacgtcccgtagggaacgtcccgttggtaaacgttcggttaacgtttttcggtaaccgtttaacggttttaaccctttaccggtttgttacccgtaacggtccgtacggttcccggttacccggacccccgtaccggtcccccgtcgttacccggtaccgggtttccgggggacccggggggtaaccgtacgggggttaccgggaaggtacggttacgggaaacggtaaccgtaacggtcggttaacgggccgttacggaccgtacccgtacgtttccgttcgttccgtttaaccg

SEQ ID NO: 346238 - DNA, 685 bp, Homo sapiens
  misc_feature: GZ8MTXP02FWDWD.45.36.D03.1.454.CMB.2.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgtgacacagtctccaggccaccctgtctctgtctccgagggganacacgcccaccctctcctgcagggccaggtaggagtgtcaagtaagtactaggctaggtaaccaanagaaacctggaccaggcctcccgaggcctcctcactccatgatgcactacccgaaacgtacgggtcccctggcccgtacccgagtaccgtagggttcccggtggcccgtagggtcgggtcgtaggggactaggtacgtttccaccttcgtaccgacccgtgacgccgacgtccgtagggacgcccgtagtattgttacgtttcggactttacgtttaccttcgtgttacacgtccgtacggtcccgttaccccgacctaccgggtcccctcgttacccgttaccggggtttccgggggaccgggggtaaaccggtgggggtacggaacggtaggtacgggaacgtaacggtaacggttcggtacggccgttacgaacgtaaccgtattccggttcttccttactacgtttcccccg

SEQ ID NO: 346239 - DNA, 617 bp, Homo sapiens
  misc_feature: GZ8MTXP02HWIRQ.45.36.D03.1.454.CMB.2.raw
  modified_base (203)..(203): a, c, t, g, unknown or other
  misc_feature (203)..(203): n is a, c, g, or t
  modified_base (277)..(277): a, c, t, g, unknown or other
  misc_feature (277)..(277): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtcctcgagggganacacgccaccctctcctcgcaggggccaggtaggagtgtacagtaagtacttaggctggtaccaacacgaaccnggccaggcctcccgagcctcctcatccatcgatcgacactcccaacgcgggtcctggtccgtaccgagacgtacggtccgtggccgtagggtcggtcgtaggggactaggtgttccacgttcnccaccgtnacgcacgtccgtaggacgccgtgattgttattttcggactttacgtttacgttcgtagtcaggtacctggttcccgttaccccgcgtacccgccctcgtaccgttcgggttcgggggaccgggggtacgtagggggtcgaaggtcgtacggacggaacggtacgtgcggtctcgaaccgaactcgtctcggttccctatccgtttcccc

SEQ ID NO: 346240 - DNA, 751 bp, Homo sapiens
  misc_feature: GZ8MTXP02FQVAS.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggganacacgccaccctctcctgcagggccaggtaggagtgtcagtaagtacttaggctacggtaaccaaacagaaaccctggacccaggtcctcccgaggcctcctcactccatgatgacatccaagcgggtcctgggcctcccgagtactacggttccgtggccgtaggttgggtacgtacggggaactaggttacggttccaccgttaccgtaccgtaacccggttaccgaacgacccgtaagggtcccccgtaggggtaccggtaccccgttggtaaagttcggtttacgtttttacggtaccgtttaaacggggtttttacctttacccgttggttacccgtaaacgggtcccgttaaacgggttcccgtttccccggacccggttaaccccgccccgttacgtttacccgtaccgggttttaccgggggccgggggtaacccgtagggggttacggacggtaagtacggaacgtaacgggtaaccgtttggacggtcgtacgtaaccgaccgttacgttccgtcgttaccttacgtaccctttccccg

SEQ ID NO: 346241 - DNA, 821 bp, Homo sapiens
  misc_feature: GZ8MTXP02GPMPR.45.36.D03.1.454.CMB.2.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcgagggccaggtaggagtgtcaagtaagtacttaggctggtaaccaanagaaacctggccagctcccacggctccncactccatcgatcgcaactcccgaaaacgtcgggtccccgtacgggccgtaccccgtaacgtaaccggtaccgggtttcccgggtacggggaccccgtaaggggttcggggttaccgtacgggggtaacccaagggttaccgggtttaccacccttacccgttacccgtaccccgtacccgaaggacccgaccgggtcccttagggggaaccggtcccttaggggaattcgtttagttttcggaccgtttaaggtttttaacccttgttcgtttacccgaagtccgtaacgggttcccggtttccccgtccccgtaacccgggcccccttaccgtccccggtttaaacccgggtttcgggggggaccccggggggacccggtaagggggttgggaaaaccggtggggttacccgggaaggaaacccgggtaaaagttcccggggttaagggtccccgtagggtaacccgaaacccccttagttccccggttcgtttaccctttccggttaactttcccccccgg

SEQ ID NO: 346242 - DNA, 590 bp, Homo sapiens
  misc_feature: GZ8MTXP02FFF4P.45.36.D03.1.454.CMB.2.raw
  modified_base (324)..(324): a, c, t, g, unknown or other
  misc_feature (324)..(324): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagcccacctctcctgcagggccaggtaggagtgtcagtaagtacttaggctggtaccaacagaaacctggccaggctcccgaggcctcctcatccatgatgcatccaaacgagggtcccnggccgtcccaagacaggttcccgtggccaggtggctggggacagagttcacgtctacgaccgtnagcagcctggacgccgtgatgtatttgcttagtttcttactgtcgtagctacggtccgttacccgcccgaccggtcccgtccgttaccgtacggtttccggggaccggggggtacccgtagggggtacgggagtacggtgaacggaacggtaacgtcggtacggcgtacggcactacgtctcggttactacgtactttcccg

SEQ ID NO: 346243 - DNA, 648 bp, Homo sapiens
  misc_feature: GZ8MTXP02HNKFJ.45.36.D03.1.454.CMB.2.raw
  modified_base (290)..(290): a, c, t, g, unknown or other
  misc_feature (290)..(290): n is a, c, g, or t
  modified_base (399)..(399): a, c, t, g, unknown or other
  misc_feature (399)..(399): n is a, c, g, or t
  modified_base (460)..(460): a, c, t, g, unknown or other
  misc_feature (460)..(460): n is a, c, g, or t
tcagacgcgatcgacacgaccggtgctcgatttagctgcgtcacgatctctcttggggaggaactgctcagttaggacccagagggaaccatggaagcccccagctcagcttctcttcctcctgctactctggctcccagataccaccggaaaattgtgttgacacagtctccaggcaccctgtctctgtctccaggggagacagccaccctctcctgcagggccagtaggagtgtcagtaagtacttaggctggtaccaacagaaacctggccaggctcccaggctccncatccatgatgcatcccaaacgcgggtcccctgggcctcccgagaccgtacgggttcccgtggccctagggtcgggtctaggggacaggtcttccgactctcaaccgtnacggctacggccctgggacgtcctggacttggtatttgacttacgttttctgttcggtacncgtccgtacggttccgtacccgacccgtacccgtccgtacccgttcggttaccggggtttccggggggacccgggggtacggtaagggggtacggtacggtacggtagggtaacggaaccggtacggtcggtcgtcgtacgaaccgtaccgtacgttccgttcgtttacctttacgtaccgttccccg

SEQ ID NO: 346244 - DNA, 745 bp, Homo sapiens
  misc_feature: GZ8MTXP02HSGBJ.45.36.D03.1.454.CMB.2.raw
  modified_base (370)..(370): a, c, t, g, unknown or other
  misc_feature (370)..(370): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccaccctctcctgcagggccagtaggagtgtcagtaagtacttaggctggtaaccaacagaaacctggccaggctacccaggcctcctcatccatcgatcgacacgtcccaaaacgtcggggtccccctagggcccgtacccaagaccgtacgggttcccgnggacccgtacgggttcggggtactgggggaacctagggtacgtttcctaccgttccgtacccgacccgttacgaacgtccgtaacggcccgttagggaccgtacccgtaggtacttagggtttaactttttcgggacttttaaacgggtttttaccttcgttacggttacctaaacggtcccgtaaacgggtttccccggtttccccgaacccgtacccggtcccggtaaccttcccggtaccgggtttccgggggaccggggggtacccgtagggggtcgggtaacgacggttaagggacggtaaaccggttaacgtgggtacggtcgtacggaacctaccgacgtttcgacgtttcttacctacgtttccccg

SEQ ID NO: 346245 - DNA, 579 bp, Homo sapiens
  misc_feature: GZ8MTXP02JZ10K.45.36.D03.1.454.CMB.2.raw
  modified_base (269)..(269): a, c, t, g, unknown or other
  misc_feature (269)..(269): n is a, c, g, or t
  modified_base (388)..(388): a, c, t, g, unknown or other
  misc_feature (388)..(388): n is a, c, g, or t
  modified_base (452)..(452): a, c, t, g, unknown or other
  misc_feature (452)..(452): n is a, c, g, or t
  modified_base (501)..(501): a, c, t, g, unknown or other
  misc_feature (501)..(501): n is a, c, g, or t
  modified_base (567)..(567): a, c, t, g, unknown or other
  misc_feature (567)..(567): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggggaggcgttgtccagcctgggaggtccctgagactctcctgtgcagcctctggattctccctcagttaactttggtttccacgtgggtccgccaggttccaggcgaaggggctgggaggtgggtcggccctctatttccgaagntggaagtgagaaggcctactcagactcgtgaaggccgctcacatctccagagacaatccaagaatgtccttctttttgactaaatgaatagcctagagtagtgagactacgtctgtctnttctgtgcgagggggacagtctatgatcgtggttcgtagtagtaatactaactactactacctntagtggacgtcgtagggacgaaacgggtctcggtcaccgttcgccgacncgcttcccaaccgacggccctactccggtccttcccccgtggcccgtcccgtcgcctccgacggcnccgaccgtcggg

SEQ ID NO: 346246 - DNA, 628 bp, Homo sapiens
  misc_feature: GZ8MTXP02JRVWL.45.36.D03.1.454.CMB.2.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (414)..(414): a, c, t, g, unknown or other
  misc_feature (414)..(414): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagcccaccctctcctgcaggggccaggtaggagtgtacagtaagtactaggctggtaacaanagaaacctggccaggcctccgaggctccncactccatgatgcataccaacgacgggttccccgtggccgtacccaggaccgtacggggttcccgtggccgtacgggttggggtcgtaggggactaggtacgttcactctcgaccgtnacgcacgccgtggacgcctgattgtatttgacttagtttactcgttgtacagtcacgtccgttcccgcctaccgccgtctccgtaccggtttcgggggaccgggggtaccggagggggtacggaggtagtagggaaccggtaacggtaacgtgggtcggaccgtcggaaccgtacccgtacgttcgttcgttacctttccgtacctttaccccg

SEQ ID NO: 346247 - DNA, 624 bp, Homo sapiens
  misc_feature: GZ8MTXP02FO742.45.36.D03.1.454.CMB.2.raw
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
  modified_base (429)..(429): a, c, t, g, unknown or other
  misc_feature (429)..(429): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagccaccctctcctgcagggccaggtaggagtgtcagtaagtacttaggctggtaaccaacagaaacctggccaggcctcccgaggcctcctcatccatgatgcatccaacgcggggtccccnggccgtacccagaccgtacgggttccgnggacccgtagggtcggggtactggggaacaggtaacgttccaccgttctaccgaccgtcagcacgccgtggacnccgtagtagttgtactttcgacttagttttacttcgtgtactacgccgaacgtcccgttcccggaccctaccgtcccgtaccttccgtaccggtttccgggggccgggggaaccgtggggtacggacggagtaggacgacggaacgtcggtcggactcggaacgtacctacgttcgtcgttctacctcttccccg

SEQ ID NO: 346248 - DNA, 826 bp, Homo sapiens
  misc_feature: GZ8MTXP02JARZD.45.36.D03.1.454.CMB.2.raw
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacacgcccaccctctcctgcgagggccagtaggagtgtcagtaagtacttaggctggtaaccaacgagaaacctggaccaggcctacccgaggtcctcctacgactacccatcgaatcgaccaactaccccgaaacggtacggggtccccctaggggaccccgttacccaacggtacgtaacggggtttcccggtgggacccgtaggggttcggggtacgtagggggaacctaagggtacgtttcccgaaccgttcccgtacccgtaacccgttaccgaacggtcccgaaccgggtcccgtacggggaaccgttcccgtaggtaacgttagggtttaactttttcggaaccgttttaacgggtttttaaccttccgttaggttaccgtaacgaccggttacgtccccggttcccccgacccgtacccggtcccgttacccgtaccggtttacccgggggtttaccgggggaccccgggggggtaaaccgtaggggggttacggaaaggtacggttacggggaaaacgggtaacccggtaaacggtttacgggccgggtaccgttacggcccgtaaaaccttacggttccgttacccgtttccttacccggtacgttttccccccg

SEQ ID NO: 346249 - DNA, 503 bp, Homo sapiens
  misc_feature: GZ8MTXP02JIWBW.45.36.D03.1.454.CMB.2.raw
  modified_base (202)..(202): a, c, t, g, unknown or other
  misc_feature (202)..(202): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (341)..(341): a, c, t, g, unknown or other
  misc_feature (341)..(341): n is a, c, g, or t
  modified_base (441)..(441): a, c, t, g, unknown or other
  misc_feature (441)..(441): n is a, c, g, or t
  modified_base (492)..(503): a, c, t, g, unknown or other
  misc_feature (492)..(503): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcaacgaggttccgtggcagtggtctggggacagngttcactctcaccgtnagcagcctggagcctgatgattttgctagtttactctgtcagcagcccgttccnccacgccgctcgacgtttccgggggcgggggaccagggggtcgagtagtcggagaaccgactggtcgctgccaccatctgtctcacttctcccgcattcngactcgatccggctcgtgcggcggggctggccgaaggccgcgaagtcgcgnnnnnnnnnnnn

SEQ ID NO: 346250 - DNA, 588 bp, Homo sapiens
  misc_feature: GZ8MTXP02FQZS8.45.36.D03.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (400)..(400): a, c, t, g, unknown or other
  misc_feature (400)..(400): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtcttaggctggtaccaanagaaacctggccaggctcccaggctcctcatccatgatgcatcccaaacgacgggtcccctgggcccgtacccgagaccagggttccccgtggcccgaggttgggctaggggaccaggtagttccactctcacccgtnaagcagccgtggacgcctgatgtattgctagtttacttacgtgtctagctagtccgttcccgcctaccgcccgcgtccgtacggtttccgggccgggggtaccgtaggggtcggacggtagtacggagtaacggtaacgtggtacggcgtacggctaaccgtacgtcgtcggttcctactacttcccg

SEQ ID NO: 346251 - DNA, 698 bp, Homo sapiens
  misc_feature: GZ8MTXP02HXNNO.45.36.D03.1.454.CMB.2.raw
  modified_base (212)..(212): a, c, t, g, unknown or other
  misc_feature (212)..(212): n is a, c, g, or t
  modified_base (660)..(660): a, c, t, g, unknown or other
  misc_feature (660)..(660): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacacgccaccctctcctgcacgggccagtaggagtgtcagtaagtactaggctggtaccaacgagaaacctggccaaggcctacccgaggcctcctacactccatgaatcgcctaactccccgaaacgtacggggttcccctagggcccgtaccccgaaggaccggttacgggttccccggtacgggtccgtacgggttcggggttcgtacggggaactaggggtcgtttcccgtaacgtcccttaccgaaccggtcaacgccgacgtcccgtaggacgtcccgtagtagtacgtttatttcggtacgttacgtttacgttcttcggttactaggtaccgtacgtccggttacccgccgtacccggcccgtcgtaccggtaccggtttcgggggaccgggggtaccggtaggggtcgggtagagtacggaacggtacgaacggttggnggtccgtcggactaccgtgtccgtttcgttccttaccg

SEQ ID NO: 346252 - DNA, 675 bp, Homo sapiens
  misc_feature: GZ8MTXP02G80HL.45.36.D03.1.454.CMB.2.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (667)..(667): a, c, t, g, unknown or other
  misc_feature (667)..(667): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccgagggganacacgccacctctcctgcgacgggccaggtaggagtgtacagttaacgtacgttaggtctacggtaaccaacgaacgtaaacctcgaccaggcctacccgagcctccacactaccagtgatcgctactaccgaacgtacggtccccgngtaccgaccgaagtaccgtacgggtccggtggaccgtaggttcgggtacgtagggacgtacggtacgttccgacgtccgtacgtaccgtacacgacgtacggtcccgtaggacccgtcgtagacgttggtttaactttcgaacgttttaagtttcgtcgtagttaccgagccgttacggttcccgtaccgcccgttacgcccgtcgttaccgggtacgggttaccggggggaccgggtacggtagggggttacgaagaccgggttaggaaacggtaccgtagtcggacggtctacgaacgtactgttctacgtctacnctttcccg

SEQ ID NO: 346253 - DNA, 620 bp, Homo sapiens
  misc_feature: GZ8MTXP02FPV0F.45.36.D03.1.454.CMB.2.raw
  modified_base (605)..(605): a, c, t, g, unknown or other
  misc_feature (605)..(605): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctccagataccaccggaaaaattgtgttgacacagtctccaggcaccctgtctctgtcctccgaggggagacagccaccctctcctgcgagggccagtaggagtgtacagtaagtacttaggctaggtaccaaacagaaacctggaccagggcctccaggctccgcactccatgatgcactccgaacgacgggtcctgggcctcccagactacggttccccgaggccaggtcgggtcgtacgggacagggtacttccgacgttcctaccgacccgtacgagtacccacgtacccgttaggaaccgccgtagtacgttcggttaattttcgatttacgtttacttcgtgttacagtcgacgttccgttaccgcccgtacgccgtctcgtacggttccggggacgggggtaccaggggtcgaggtacgtaggaacgacgtacgtggtacgtcgtcgacctaacgtntcgtcgtctttaccg

SEQ ID NO: 346254 - DNA, 701 bp, Homo sapiens
  misc_feature: GZ8MTXP02JOUP9.45.36.D03.1.454.CMB.2.raw
  modified_base (212)..(212): a, c, t, g, unknown or other
  misc_feature (212)..(212): n is a, c, g, or t
  modified_base (439)..(439): a, c, t, g, unknown or other
  misc_feature (439)..(439): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcagggccaggtaggagtgtacagtaagtcttaggctaggtaccaacagaacctggaccaggcctcccgaggcctcctacatccatgatgacactaccgaacgacggggtcccctgggccctacccgaggacgtacgggttcccccgtgggactagggtcggggtactaggggaactagggtacgttcaccgttccgacgtacccggtanacgacgtacgtccgtaggacgtccgttagtacgttagttacgttttacgtacgtttacgttttacgttcgttacgtacgtacgtacgtaccggttccccggttacccgacccgtacccggtcccgtaccgttaccggttaccggggtttacccgggggaccgggggtaaccggtagggggtacggacggtacggtacgggaacggtaacgtacggttgggtacggtcgtacggacctaccgttgtccgttacgttacctacg

SEQ ID NO: 346255 - DNA, 632 bp, Homo sapiens
  misc_feature: GZ8MTXP02GZ5DA.45.36.D03.1.454.CMB.2.raw
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggttcccagataccaccggaaaaattgtgttgacacagtctccaggcaccctgtctctgtctccgaggggagacagccaccctctcctgcagggccagtaggagtgtcagtaagtacttaggctggtaccaacagaaacctggccaggctcccaggctccncatccatgatgcatccaacgcgggtcccnggctcccagaccnggttccgnggctggtggtcgtggacagtacgttcncctcacaccgtcagcacgccgtgacgtccgtgagtgttagtttgacttacgtttacttcgtacgtctacgctacggtccgttcccgccgaccggtcccgtaccgttccgttaccgggttccgggggaccgggggaccggtagggggtacggacggtaacggtacgggaacggtaacggtaacgttcgggtacggtccgaccgtaccgtaaccgtacgttaccgtttacgttacccgtttaccgtaccgtttccccgttccccg

SEQ ID NO: 346256 - DNA, 672 bp, Homo sapiens
  misc_feature: GZ8MTXP02F7JZ3.45.36.D03.1.454.CMB.2.raw
  modified_base (325)..(325): a, c, t, g, unknown or other
  misc_feature (325)..(325): n is a, c, g, or t
  modified_base (544)..(544): a, c, t, g, unknown or other
  misc_feature (544)..(544): n is a, c, g, or t
  modified_base (646)..(646): a, c, t, g, unknown or other
  misc_feature (646)..(646): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaaccggaaaaattgtgttgacacagtcctccaggccaccctgtctctgtctccgaggggagacacgcccaccctctcctgcgagggccaggtaggagtgtcaagtaagtacgttaggctaggtaaccaacgagaaacctggaccaggcctcccgaggcctcctcactccaatgatcgcanacccgaacgacgggtcccctgggccgtacccgagaccgtacggttccggtggaccgtaggggtcgggtacgtcggggtaactaggtacgtttccacgttccgtaccgtaaccgtcaacggccgacggtacccgtaggacgtacccgttaggaacttgggttattttcgacgtttaacgttttacttcgtgttacgacgtaccgtcggtcccgttacccnccgaccgtcccggtctccgtacgggttccggggaccgggggtacgagggggtcggaagacgtaggaacggtaacggtaagtcggtacggtcacgcgtaaccngttcctacgttctactcgttaccccg

SEQ ID NO: 346257 - DNA, 565 bp, Homo sapiens
  misc_feature: GZ8MTXP02JNJ6G.45.36.D03.1.454.CMB.2.raw
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (331)..(331): a, c, t, g, unknown or other
  misc_feature (331)..(331): n is a, c, g, or t
  modified_base (483)..(483): a, c, t, g, unknown or other
  misc_feature (483)..(483): n is a, c, g, or t
tcagacgcgatcgacacgaccggtgctcgatttagctgcgtcacgatctctcttgggtttggggggaagaggaagactgacggtcctcccaggagttcaggtgctgggcaccttgggcacgggggagcgttgtccagcctgggaggtccctgagactctcctgtgcagcctctggattctccctcagttaactttggtttccactgggtccgccaggttccaggcaaggggctggagtgggtgccctnattccgaagntggaagtgagaagcctactcagactccgtgaaggccgcttcaccatctccagagacattccaagaatgtcctnttttgactaaatgaatagcctgagagttgaggacacgtctgtctatttctgtgccgagggggacatctatcgagtctggtctagtgtatactaactactacgtactcatggacgtcgtggggacaaaagggcctacggtaccaccggttccnccgcgtacgtccgtaccacgacggccctacgtccgtcccttcccgcgcccgcccgtcgtacctcgacgccaccgtacgtcgg

SEQ ID NO: 346258 - DNA, 652 bp, Homo sapiens
  misc_feature: GZ8MTXP02JUPIP.45.36.D03.1.454.CMB.2.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagccaccctctcctgcagggccaggtaggagtgtcagtaagtacttaggctaggtacaacagaaacctggccaggcctcccgaggcctcctcactccatgatcgcactaccaacgcgggtcccctgggccgtacccagacgtcggttccggnggacccgtagggttcgggtcgacggggacacggtacgttcaccgttctaccgaccgtcgacgacctacggccgtacgggactccgtgtagttcgtagttttcgactttaacgtttactcgtgttacgacggtcctacggtccgttcccgcccgtaccggtccctccgttacccggtacggtttccgggggaccgggggtaccgtagggggtacggtaggacgtagggaacggtacgaacggtgggtacggtcgtacgaaccgtaacctgttccgttgttaccttctaccttcccg

SEQ ID NO: 346259 - DNA, 726 bp, Homo sapiens
  misc_feature: GZ8MTXP02IMIEM.45.36.D03.1.454.CMB.2.raw
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggggaggtgtgtcacaagatttgggctctgggcaccgtgggcagtgggggagcgttgtccagcctgggagtccctgagactctcctgtgcagcctctggattcctccctnagttaactttggtttccacgttgggtccnccgtaggttccaggcgaaggggctggagtgggtgccctnattccgaagntaggagtgagaggcctatcagactccgtgaacgggccgcttcaccatcctccaagacgacctaaacttcccaaagtaaacttcgttacccttactttttggacctaaaagttagtaaaatacgcctaggtaagagtttagaacggtacaacggttctgttacttacttttcgtgttacggacccggaagggggtactaattaccgttaagttcggtaacggtttccgttagggtttaccggttaaggttaaggttaaacgtactaaaaccttaacttaaaccttaaccgttactaaacggtcggtaacggttacggtacgggggtaaccgtaaaaacggggtcccgttaaccgggtaaccgtaacccggttaccgcccggtactaccgggttaccctttacccgaaaaccccggg

SEQ ID NO: 346260 - DNA, 660 bp, Homo sapiens
  misc_feature: GZ8MTXP02I537N.45.36.D03.1.454.CMB.2.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacggggggaggcgttgtccagcctgggaggtccctgagactctcctgtgcagcctctggattctccctcagttaacttttggttccactgggtccnccaggttccaggcaaggggctggagtgggtcggcctnattccgaagntggaagtgagaaggcctactcagactcgtgaaggccgctcaccatctcagagacaattccaagaatcgtccttcttttgactaaatagaatagcctagagtagttgagacacgtntgttctntttcgtgtcgcgagggggacagtctatgtagtctggttacgtagtagttaacgtactaaacttaactacctaccttacgtagttggaaccgttcggtacggggtaacggaaaacggggtcccgttacgggtacccaacccggttccgtacccgtacgacgtccctttaccgaaacccgtaaccggggacccctaacgttcccggttcccgttcccccgtcggtcccgtccccgtcgtcccgttacccggacggtaccgacccgtaccgtcccgggg

SEQ ID NO: 346261 - DNA, 712 bp, Homo sapiens
  misc_feature: GZ8MTXP02IAPLS.45.36.D03.1.454.CMB.2.raw
  modified_base (207)..(207): a, c, t, g, unknown or other
  misc_feature (207)..(207): n is a, c, g, or t
  modified_base (309)..(309): a, c, t, g, unknown or other
  misc_feature (309)..(309): n is a, c, g, or t
  modified_base (374)..(374): a, c, t, g, unknown or other
  misc_feature (374)..(374): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaaccggaaaaattgtgttgacacagtctccaggccaccctgtctctgtctccgaggggganacagcccaccctctcctgccgagggccaggtaggagtgtacagtaagtacttaggctaggtaaccaagacgaaacctggccaaggtccacccgaggcctccncactccatcgatgacactaccacgtacgggtccctgggccgtaccagtaccgtacggtttccggnggccgtacgggtcgggtacacggggactaggtaccgttctaccgttctaccgtaccgtacgacgcacggcccgtggacctcgtagtacgttgtttacgtttcgtacgttttacgtttccgttcgtacgtacgaccgtaccgtacggttacccgttcccgacccggtaccgtcccgtaccgttacggggttacccggggtccggggggaaccggggtacggtagggggtaccgtaaggtcggtaacgggaaacgttaccggtaacgggttcgtaccgtaccggtaccaacccgtacgtacgtttccgttacgtttacccttaccgttacccttccccgg

SEQ ID NO: 346262 - DNA, 572 bp, Homo sapiens
  misc_feature: GZ8MTXP02JZ07E.45.36.D03.1.454.CMB.2.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (503)..(503): a, c, t, g, unknown or other
  misc_feature (503)..(503): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaaccaacgagaaacctggaccaggcctcccgaggcctcctcactccatgatgcatccaacngggtccccngggcctcccagacgtaggttccgtggcccgaggtgggtctggggactaggacgttccacgtctccgacgtcagcagcccgtggactccgtagacgttgtagtttcgctagtttactctgtcagcgtagtcgttccgaccgcgccgtcctcgaccggtttcggggccgggggtacgngggggtcgacggagtgacgacggaagtcggtacgcgtgaaccgacctagtctcgtcttctacgttcccg

SEQ ID NO: 346263 - DNA, 671 bp, Homo sapiens
  misc_feature: GZ8MTXP02FR7WS.45.36.D03.1.454.CMB.2.raw
  modified_base (263)..(263): a, c, t, g, unknown or other
  misc_feature (263)..(263): n is a, c, g, or t
  modified_base (356)..(356): a, c, t, g, unknown or other
  misc_feature (356)..(356): n is a, c, g, or t
  modified_base (417)..(417): a, c, t, g, unknown or other
  misc_feature (417)..(417): n is a, c, g, or t
  modified_base (578)..(578): a, c, t, g, unknown or other
  misc_feature (578)..(578): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggagacagccaccctctcctgcagggccagtaggagtgtcagtaagtacttaggctggtaaccaanagaaacctggccaggcctcccgaggcctcctcatccatgatgcatcccaaacgtcgggtcccctgggcccgtcccgagacgtagggttcccgnggaccccgtaggttcggggtctagggggacaggtacgttccgacttccgtacgacccgttnacgccgacgtcccgtggacgtcccgtagtacttagttacgttttcgacgtttaaggtttttaccctttgtcgttaccgtaggtccgttacggtcccgtttaccccggcctacccgggtcccctacgtccgttacggtttccgggggaccgggggttaccgngggggtacggacggtagtacgggaacgtaccgtaaggtcggtacggtctcggaacctactacgttcgttccgttacttaccgactttcccccg

SEQ ID NO: 346264 - DNA, 640 bp, Homo sapiens
  misc_feature: GZ8MTXP02FV2ML.45.36.D03.1.454.CMB.2.raw
  modified_base (418)..(418): a, c, t, g, unknown or other
  misc_feature (418)..(418): n is a, c, g, or t
  modified_base (631)..(631): a, c, t, g, unknown or other
  misc_feature (631)..(631): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagccaccctctcctgcagggccaggtaggagtgtcagttaagtacttaggctggtaaccaacgagaaacctggccaggcctcccaggcctcctcactccatgatgcatcccaaacgacgggtccctgggcctccccgaagtaccgacggttcccggtggccctagggtggggtactggggactacggtacgttcaccgttcctacgacccgtnaacgcacgccgtaggaccgtccgtagacttgtatttcgacttagttttactcgtgtccgagtcctacggtccgttcccgaccgtacccgcccgtcgttccgtaccgggtttccgggggaacccggggggtaccgtagggggtcggtaaggtcggtacggacggtaaaccggagttcggacgtcgtacgcgaacctgttcgtcggttcttaccnctttccccg

SEQ ID NO: 346265 - DNA, 594 bp, Homo sapiens
  misc_feature: GZ8MTXP02F872F.45.36.D03.1.454.CMB.2.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtacttaggctggtaccaacagaaacctggccaggcctcccaggcctcctcatccatgatgcatccaacgngggtcccctgggccgtcccgagaccgaggttccgnggccaggtgggtctggggacagtacgttcactctcaccgtcagcagcctggacnccgtagattgtatttgcttagtttactctgtcagtcagtccgtcccgaccgaccgcccgtctccgtaccggtttccgggggccgggggaccgtagggggtcggaggacgtagggaacggaacggtaacggtcggtacgggtcgtacggccgtaaccgtacgttccgtcgttccgttcgtactttcccccg

SEQ ID NO: 346266 - DNA, 696 bp, Homo sapiens
  misc_feature: GZ8MTXP02H0UDW.45.36.D03.1.454.CMB.2.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (458)..(458): a, c, t, g, unknown or other
  misc_feature (458)..(458): n is a, c, g, or t
  modified_base (501)..(501): a, c, t, g, unknown or other
  misc_feature (501)..(501): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcacccctgtctctgtctccaggggganacagccaccctctcctgcagggccagtaggagtgtcagtaagtacttaggctggtacaacagaaacctggccaggcccacgacgcctcntacactagntcgcactaccaccgaacggtaccggtccgccggtacccgtaccgacgtaccggtccggtcggtacggaccgtagggtcgggttacggacggacgtaaggttctaccgctttcccgaaccgtacccgtacgaccgatcccgggtaagtcggccctntagtaccgttaagttttgttaccgtatttactttaccttcgtntaacgacgccgttaacgggttccccgtcccgaaccgcccgttaccgtccttcccggtttaacgggggtcccgggggacccggaagggggtcggtacgggggtaaagtacggacgggtaacggtaaccgttcggtacggtcggtccacggtaacctacgtccgtttctaccgtttccttacgtaccccgtttcccg

SEQ ID NO: 346267 - DNA, 565 bp, Homo sapiens
  misc_feature: GZ8MTXP02FOVIW.45.36.D03.1.454.CMB.2.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcagggccaggtaggagtgtcagtaagtacttaggctggtaccaanagaaacctggcaggctccagctccnatccatgatgacatccaaacgcgggtccctgggcctcccgagaccgaggttccgtggcctaggtcggtcgtggggacaggtgttccactctcgaccgtcagtcagccgtggactcgtagactgtatttcggacttacgtttactctgtactagctacggccgttcccgaccgtaccgcccgtctacgtacggttcggggagggggaccgtggggtagacgagtcggacgaacgtaagtcggacgcgtagcctacgactctcgtctcgactttccccg

SEQ ID NO: 346268 - DNA, 585 bp, Homo sapiens
  misc_feature: GZ8MTXP02FTTLG.45.36.D03.1.454.CMB.2.raw
  modified_base (326)..(326): a, c, t, g, unknown or other
  misc_feature (326)..(326): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
  modified_base (574)..(574): a, c, t, g, unknown or other
  misc_feature (574)..(574): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgaggggagacagcccacctctcctgcgaggccagtaggagtgtacgagtaagtacgttaggcgtcggtaaccaacagaaacctggccagctcccaggctctcatccatgatgacactaccaacgcggtccnggcctaccagactcggtccgtggccgtaggtacggtcgtaggggactacgtagttccnctccgtaccgaacccgttcacggtacnccgtaccgtggaaccgcctagtatagttacttggtacttagtttctcgtgtcctagcgtacgccgttacccgccgcgtcccgctccgacggtttccggggacggggtacgcgggtggacgagtagacgaacgtactcggtcgctacgaactacgtactcgttntactctcgtcc

SEQ ID NO: 346269 - DNA, 652 bp, Homo sapiens
  misc_feature: GZ8MTXP02JZXVQ.45.36.D03.1.454.CMB.2.raw
  modified_base (205)..(205): a, c, t, g, unknown or other
  misc_feature (205)..(205): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccaccctctcctgcagggccaagtaggagtgtcagtaagtcttaggctaggtaccaacagaaaccgtgaccaggcctcccagctcctacactccatcgatcgacactccaaacgacgggtcccctggccgtacccgagaccgtcggttaccgtggacccgaggtggggtcgtacggggacaggtacgttcaccgtactccaccggtctacggcctacgtcccgtaggacgtccgtgtaacttggttactttcgacgttttaccgtttacttctgtccgagtccgccgttacccgttcccgactacccgccgacttcccgttacggggttccgggggcgggggtaaccagggggttgacgtagagggccgtaaaacggcgtacggttcggaccttacggaactaccccgtagtccccttagtccgtttacacccgtttccccg

SEQ ID NO: 346270 - DNA, 738 bp, Homo sapiens
  misc_feature: GZ8MTXP02F3X75.45.36.D03.1.454.CMB.2.raw
  modified_base (212)..(212): a, c, t, g, unknown or other
  misc_feature (212)..(212): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
tcagacgcgatcgacacgaccggtgctcgatttagctgcgtcacgatctctcttgggggccctggggaggaactgctcagttaggacccagagggaaccatggaagcccccagctcagcttctcttcctcctgctactctggctcccagataccaccggaaaaattgtgttgacacagtctccaggcaccctgtctctgtctccgagggganacagccaccctctccgtgcgagggccaggtaggagtgtacagtaagtacgttaggctaggtaccaacagaaacctggccaggcctacccgaggcctccgtacatccatgactgaccataccaacgcgggtcccnggaccgtaccagacgtacggttcccgtgaccgtaggtgggtcgtacgggaacnggtgttccaacgtccgttcaacccggtnacggtaccacggtccgtagggactccgtgtaagttcgttacttttacggacgtttacggttttaccttccttacgggtacctaacgggtaccgtcggtttacccccgggttaccccgcccccggtaacccggtccccgtcgttacccggttaacccggggtttccggggggcccggggggtaaacccggtagggggttaccgggagggttaaacggttacgggaacgggtaaccgttaaacggggttcggtacgggtaacccgttcgggaacctaaaccggtcttacggtttccggtttacctttaacccg

SEQ ID NO: 346271 - DNA, 691 bp, Homo sapiens
  misc_feature: GZ8MTXP02H9Q0T.45.36.D03.1.454.CMB.2.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (468)..(468): a, c, t, g, unknown or other
  misc_feature (468)..(468): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccgagggganacagccaccctctcctgcgagggccaggtaggagtgtcagtaagtactaggctaggtaccaacagaaacctggaccaggcctacccgaggcctcctcactcccatgatgacataccaacgacgggtcccctggccgtccagaccgtacgggttccgnggccgaggtcggggtcnggggactaggtacgtttcacgtctcgaccgtnacgcacgccgtgggacgtcctgactgttattttcgactttagttttacttctgtacgngtacgtacggttcccgtttcccgaccgtacccggtcccgtaccgttaccggttacccggggtttccggggggacccggggggtacccgtacgggggggttaacgagggtaaacggttcggggaaacggtaaacccgggtaaacggttcgggtaccggtccgtaacggcccgtaaacccgtacgtttcgttaccgtttccctttaaccggtaccgtttcccccg

SEQ ID NO: 346272 - DNA, 553 bp, Homo sapiens
  misc_feature: GZ8MTXP02JOI11.45.36.D03.1.454.CMB.2.raw
  modified_base (201)..(201): a, c, t, g, unknown or other
  misc_feature (201)..(201): n is a, c, g, or t
  modified_base (262)..(262): a, c, t, g, unknown or other
  misc_feature (262)..(262): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (524)..(524): a, c, t, g, unknown or other
  misc_feature (524)..(524): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaanagaaacctggccaggctcccaggctcctcatccatgatgcatccaacgagggtcccctgggcctcccagaccgtaggttccgtggcccgaggtggggtctggggacaggagttccactctccgaccgtnagcagcctggacncctgatgtatttcgntagtttactctgtcagcacgtcgtccgccacgcccgtctcctacggtttccgggggcgggggaccagggggtggagagtggaacgtccggtaaacgtggcggccncgaaccacgtatctgtacctcacttcccg

SEQ ID NO: 346273 - DNA, 695 bp, Homo sapiens
  misc_feature: GZ8MTXP02FKXJL.45.36.D03.1.454.CMB.2.raw
  modified_base (263)..(263): a, c, t, g, unknown or other
  misc_feature (263)..(263): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccagacaccctgtctctgtctccaggggagacagccaccctctcctgcagggccagtaggagtgtcagtaagtacttaggctggtaccaanagaaacctggccaggcctcccaggcctcctcatccatgatgcatcccaacgtacgggtcccctgggccgtcccagaccgaggttcccgtggccgaggttggggtctcggggacaggtagttccaacgtctccgaccgtcagcacgccgtaggacgcctgatcgtatttggcttagttttactcgtcgtacgacgtcgtaggtcccgtttacccgcccgtaccggtccccgtcgttacccgtaaccgggttttcccggggggaccggggggtaacccgtaggggggttacgggaaacgggtagttacggggaaacggtaaacccgggtaaaccggtttgggggtaaccggggcccttacggggtaacccacccccgtttaaagtttccccgttagggttttaccccgttccttaacccggtttttaccccccg

SEQ ID NO: 346274 - DNA, 651 bp, Homo sapiens
  misc_feature: GZ8MTXP02I2AD8.45.36.D03.1.454.CMB.2.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcacgggccaggtaggagtgtcaggtaagtacttaggctggtaacccaacgacgaaacctggaccaggcctcccgaggcctcctcaactccatgatcgactactacccaacgtcgggtccctgggccctaccgagacgtacggtccgtgccgaggtgggtctgggacaggtacgtcactctaccgaccgtcagcgagcccgtggactccgtgtactgttagtttcgacttagttttacctgtgtacagtctacggttccgttacccgccgtaaccgcccgtacttccgtaccggggtttcgggggaccgggggtacgtagggggttacgaaggtagttacgggaacggtaacggtaacgttcgggtacggtccggtacgtaaccgtaaccgtcgtttccgtaacggtttcccttacgtacccgttttccccg

SEQ ID NO: 346275 - DNA, 697 bp, Homo sapiens
  misc_feature: GZ8MTXP02G75BW.45.36.D03.1.454.CMB.2.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgagggganacagccaccctctcctgcgacgggccaggtaggagtgtcagtaagtacttaggctggtaaccaanagaaccgtggaccaggcctcccgaggcctaccgtacatccaattcgatcgacactacccgaacgtaccgggtccctgggacccgtcccgaaggaccgtacggttcccggtaggcccgtagggtcggggttcgaggggacctaggtacgttccacttcgtaccgacccgtcaacgccaggcccgtagggaccgtccgtagattggttattttcggactttagttttaccctgtagtcgtagctacggttccgttcccgaccgtaccggcccttacgtaccccgttacgggttcccggggggacccgggggtaaccgtgggggttaccgaaggtacgttacgggaaccggtaaaccggttacgttggggaacgtccgtacgaacccgaaacccggtttcgttcgtaccgtttaccgtaccgtaccgtttcccg

SEQ ID NO: 346276 - DNA, 594 bp, Homo sapiens
  misc_feature: GZ8MTXP02JMS06.45.36.D03.1.454.CMB.2.raw
  modified_base (213)..(213): a, c, t, g, unknown or other
  misc_feature (213)..(213): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagacgcgatcgacacgaccggtgctcgatttagctgcgtcacgatctctcttgggggccctggggaggaactgctcagttaggacccagagggaaccatggaagcccccagctcagcttctcttcctcctgctactctggctcccagataccaaccggaaaaattgtgttgacacagtctccaggcaccctgtctctgtctccgagggganacacgcccaccctctcctgcagggccaggtaggagtgtcagtaagtactaggctggtaccaanagaacctggccaggcctccgagcctccncatccatgatgcatccgaagtccggggtccctaggccctaccccgaggtaccgtacggttcccccgtggacgtaggtcggggtcgtaggggacngtacgtttcacctacgtccaacccgtnacgcncgccgngcgtcgtgatgttagtttcgtacgttagtttcttatcgtactcgtacgtacgtccgtcccgccgtccgcctcgtccgtccgggttcggggcgggtacggagggtaggagacggtacgacggtacgacgtggacgcgacgacacgtcgtcttcgtctcg

SEQ ID NO: 346277 - DNA, 610 bp, Homo sapiens
  misc_feature: GZ8MTXP02FLSPX.45.36.D03.1.454.CMB.2.raw
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagttaactttggtttccactgggtccgccaggttccaggcaaggggctggagtgggtggccctcatttccgaagatggaagtgagaaggctactcagactccgtgaaggcgctcacatctcagngacaatccaagaatgtctcttttnacaaatgaatagcctgagagtgagacacgtctgtctattctgtgccgagggggacatctatgagtctggttcgtagtagtaatcaaacttactaaactacctacgatggacgtggtcgggacgaaagggtacccgtacggtaccgtaccgtctaccgcaacgcctttacccgaaccgaaacggggcccctaacgtacccggttacccgtttcccccgtcgggtcccgtcccccgtcggcccttacccgacggaccgacccgtacccgtcccgggg

SEQ ID NO: 346278 - DNA, 700 bp, Homo sapiens
  misc_feature: GZ8MTXP02F3MDD.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtattaggctggtacaacagaaacctggccaggctcccaggctcctcatccatgatcgcatacccaacgcgggtcccctgggcctcccgaagtaccgtagggttcccgtggaccctaggttcggggtctaggggaactaggtacgtttccaacgttcctaccgacccgttcaacggccaacgggtcccgttgggaaaccgtcccgttaggactttgttaacgtttttcggactttaacggttttacttcgttagttaccgaaaggtcctacgggtcccgtttccccgacccgtacccggtccccgtacgttccgttaaccgggtttcccgggggaccggggggtacccgtaggggggttacgaaggtacggttacggaaacgggtaaccgtaaaggtcggttacggggccttagggaaccctacggattcccgtgtttaccgtactacgtttccccg

SEQ ID NO: 346279 - DNA, 593 bp, Homo sapiens
  misc_feature: GZ8MTXP02GV04L.45.36.D03.1.454.CMB.2.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactggtccgccaggttccaggcaaggggctggagtgggtggccctnatttccgaagntggaagtgagaaggcctactcagactccgtgaaggccgcttcaccatctccagagacaattccaaagaatgtcctcttttgcaaatgaaatagcctgagagttgagacacgtctgtcttattctgtgccgaggggacatctatgagtctggttcgtagttgtaatcaaacgttactactacctacattcggacgttcgtggggtacgaaagggccctacgggtccaccgtcgccgctacgccttaccacccgtacgggccccacgtcccggtccttcccccgtcggcccgtccccgttgcccttaccgacggtaccgccgaccgttcccgggg

SEQ ID NO: 346280 - DNA, 746 bp, Homo sapiens
  misc_feature: GZ8MTXP02G8QHL.45.36.D03.1.454.CMB.2.raw
  modified_base (212)..(212): a, c, t, g, unknown or other
  misc_feature (212)..(212): n is a, c, g, or t
  modified_base (228)..(228): a, c, t, g, unknown or other
  misc_feature (228)..(228): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaaccggaaaaattgtgttgacacagtctccaggcaccctgtctctgtctccgagggganacagcccacctctccngcgacgggccaggtacggagtgtacgtaaggttaacgtacgttaggcgtacggtaaccaacgaacgaaaccgtggaccgaggccctaccgaggccctacctactactccagtacgtactcgactacctaccgaacgtaccgggtccctgggcccgttacccgacggaccgttacgggtccccgtgggtacctagggttcggggtacggtacgggactacggggtaacgtttccaccgttacctccgtacccggtacgaccggtacacggtcccgtaggcggtcctaggtacgttagtacgttttcggactttaacgtttctttacgtccgttacacgggttcaaccgggttcccgttacccgcccgtaccggtcccgtaccgtttaccgggtaccgggtttaccggggggacggggttaccggtaagggggtcggaaagtcgggtaaggaacgggtacggtaacggtcgggttacggcgtaccggtacctaacgtcgttccgtacgtacctttcccgg

SEQ ID NO: 346281 - DNA, 754 bp, Homo sapiens
  misc_feature: GZ8MTXP02HYOV6.45.36.D03.1.454.CMB.2.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (407)..(407): a, c, t, g, unknown or other
  misc_feature (407)..(407): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagtgtcaggtaagtacttaggctaggtaccaacagaaaccgtggaccaggcctccgaggcctccncactccatgactcgacctacgtaccaacgtacgggtcccctcgggaccgtacccgagaccggtaccggtccgtaggtacccgtaggttcggggtccgtaggggaacgnggttaacggtttcccacgttacccgtacccgtacccggttacgacgtaccgtaacgggtcccgtagggaaccgtcccgtaggtaactttcgggtttaattttcggactttaacggtttacccttgttagtacccgtggtaccgtacgggtttcccgttaacccccgcgacccgggtccccgtacgttacccggttaaccgggggtttccggggggaccgggggtaacccgtaggggggttagaaacgggccgtttaagggggaacgtaaccgggtaaacgtcggggttcgaaccggtcgaaaccctacggtacttccggttacgttccttacgttaccgttcccccg

SEQ ID NO: 346282 - DNA, 578 bp, Homo sapiens
  misc_feature: GZ8MTXP02FWAE3.45.36.D03.1.454.CMB.2.raw
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggtaaaaattgtgttgacacagtctccaggcaccctgtctctgtctccagggagacagccacctctcctgcagggccagtaggagtgtcagtaagtacttaggctggtaccaanagaaacctggccaggctccaggctcctnatccatgatgcataccaacgcgggtccctggcctccgagacgnggttccgngcgtaggtggtctaggggacagagttcacgtcncaccgtnagcagccgtggacgctgatgtatttgacttagtttctactggtcagcgtacgtccgttcccgaccgaccgcccgtactccgtacggtttccgggggacgggggtaccagggggtcggtagtacgtaggaacggacgtaaacgtcggtacggctacggaacctaccggtacttcgtacgttacctactactttcccccg

SEQ ID NO: 346283 - DNA, 589 bp, Homo sapiens
  misc_feature: GZ8MTXP02IJPE2.45.36.D03.1.454.CMB.2.raw
  modified_base (203)..(203): a, c, t, g, unknown or other
  misc_feature (203)..(203): n is a, c, g, or t
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgaggggganacagccacctctcctgcagggccagtaggagtgtcagtaagtacttaggctggtaaccanagaacctgccagctccagctctcatccatgatgacataccacgacgggtccccngggccgtacccagacctagggttccgnggccaggtcgggtctggggacagtagttccactctcgaccgtcagcaagtcccgtaggacgtcctgtaactgtacttttggacttaagttttactntgtactaggctacgtccgttccaccgtaccgccgtactcgtacgttcgggggaccgggggtacgagggggtcgtagtagtggaacgtacggtaacgtcgggtacggtctcgaacgtaaccctagttccgtattccgtttcacgttcccc

SEQ ID NO: 346284 - DNA, 657 bp, Homo sapiens
  misc_feature: GZ8MTXP02G9FTP.45.36.D03.1.454.CMB.2.raw
  modified_base (202)..(202): a, c, t, g, unknown or other
  misc_feature (202)..(202): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccagtaggagtgtcagtaagtacttaggctggtaccaacagaaacctggccaggcctcccaggctcctcatccatgatgacatacccaacgacggggtcccctgggccgtaccccaggacctagggttccggtggcccgtagggtgggtcgtggggacaggacgttccacgttcctaccgacccgtcgaacgccaacgtcccgtggacgtccctaggattgttagttttgcttaagttttacttctaggttacacggtcacggtccgttcccgccgtaccgcccgtcgtaccgtacggtttccgggggccgggggtaaccgtagggggttacggaagtacggtaggaacggaaccggaaacgtttggggacggttaccgacggaaccctacccgtagttccgttacggttcctttaccgtaccgtttcccccg

SEQ ID NO: 346285 - DNA, 640 bp, Homo sapiens
  misc_feature: GZ8MTXP02F63I2.45.36.D03.1.454.CMB.2.raw
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggccaccctgtctctgtctccgaggggagacagccaccctctcctgcgagggccagtaggagtgtcagtaagtacttaggctggtaaccaagagaaacctggccaggctcccgagcctaccncactccagtgatcgacatacccaaacgcgggtcccctacgggcctacccgaagccgtaggttcccggtggcccctaggggttcgggtaccgtaggggaactaggtactttcccgacttccgtaccgaacccgtnaacgcgacgccgtaggacgcctagattgtactttgacttagttttactcgtacgttcgacgtcgtacgtccgttcccgaccgtaccgcccgtcgtaccgtacggtttcggggaccggggtaccgagggggtacgagtagtaggacgaacgtaacgtcggtacgcgtacggaacctaccgtagtcccgttgtcctttacgacgtttccccg

SEQ ID NO: 346286 - DNA, 656 bp, Homo sapiens
  misc_feature: GZ8MTXP02IRA8U.45.36.D03.1.454.CMB.2.raw
  modified_base (292)..(292): a, c, t, g, unknown or other
  misc_feature (292)..(292): n is a, c, g, or t
  modified_base (645)..(645): a, c, t, g, unknown or other
  misc_feature (645)..(645): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaattgtgttgacacagtctccaggcaccctgtctctgtctccgaggggagacagcccaccctctcctgcagggccagtaggagtgtcagtaagtactaggctggtaccaacagaaacctggccaggcctcccaggcctccncactccatgatgacctactacccaacgtacgggtcccctgggccccgttacccgaaggaccgtacgggttacccgtggacccgtagggttcggggtcgtaggggactaggtcgttccacttcctccgacccgtcgacgtcgacgcccgtggacgtccgtagattgtattttcgactttagtttacttctcgtcagtcctacggtccgttacccgaccgtacccgtccgtaccgtccggtacgggtttccgggggaaccgggggtaccgtagggggtacggtaggacgttagggaacggtaaacggtacgtcggtacggctacggaacctacgtacttcgtcgttaccttaccncgtttcccccg

SEQ ID NO: 346287 - DNA, 583 bp, Homo sapiens
  misc_feature: GZ8MTXP02F15YD.45.36.D03.1.454.CMB.2.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (342)..(342): a, c, t, g, unknown or other
  misc_feature (342)..(342): n is a, c, g, or t
  modified_base (388)..(388): a, c, t, g, unknown or other
  misc_feature (388)..(388): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtcttaggctggtaccaanagaaacctggccaggctcccaggctcctnactccatgatgcatccaacacgggtccctggccgtcccagacaggttccgnggcctaggtgggtctggggactaggagttccactccgtacaccgtnagcagccgtggagcccgtgattgtatttgacttacgtttacttctacgtctaagctacggccgttcccgacctaccggcccgcgtaccgtcggtttccgggccgggggtaccgtgggggtcgaaggtagaggtacgaacggtaacgtggttcgacgttcgaacgtaccacgtcgttacgtccttacacttccccg

SEQ ID NO: 346288 - DNA, 542 bp, Homo sapiens
  misc_feature: GZ8MTXP02JYVQQ.45.36.D03.1.454.CMB.2.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (355)..(355): a, c, t, g, unknown or other
  misc_feature (355)..(355): n is a, c, g, or t
tcagacgcgatcgacacgaccggtgctcgatttagctgcgtcacgatctctcttggggagctctgggagacgagcccagcactggaagtcgccggtgtttccttcggtgatcatcactgaacacagaggactcaccatggactttgggctgacctgggttttcctcgttgctcttttaagaggtgtccagtgtcaggtgcaggtggtggagtcgggggagcgttgtccagcctgggaggtccctgagactctcctgtgcagcctctggattctcccctcagtaactttggtttccactggggtccnccaggttccaggcaaggggctggagtgggtggccctnagtttccgaagntggaagtgagaaggcctactcagactccgtgaacgggccgcttcgaccatctccagagacaataccaagaatgtaccttcttttagactaaatgaattagcctgagagttgaggacacgtctgtcgtattctgtcgccgagggggacatcgtatgaagtcgtggttcgtagtagtaactactaaccg

SEQ ID NO: 346289 - DNA, 672 bp, Homo sapiens
  misc_feature: GZ8MTXP02GLWJ0.45.36.D03.1.454.CMB.2.raw
  modified_base (391)..(391): a, c, t, g, unknown or other
  misc_feature (391)..(391): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctcagtaactttggtttccactgggtcccgccaggttcctacggcgaacggggcgtcggaggtgggtcgggcccgtccagtttccgtaacgagtggaaggtagagaacggcctacgtcagatccgtgaggccgctctacatctccagagacacttacaagatgtcctctttatacgaaatagtatatctgagacgttgagacacgtntgttctatttctggtcgtacgacgggggaactatcgtagtgtacggtcgttagtcggttagtagtaactactaactacgtactacctactagtacggtacgttcgtacggggaccgtaaaacgggtacccgtccggttaccggtacccggttccctcggacccggacgtaccgttacccctacccgggaaaggggtacccccttaccggtaccggtttccccgtccccccttcgggcccggtaacccctcgtacctccgacggtacggcctacccggtcgg

SEQ ID NO: 346290 - DNA, 570 bp, Homo sapiens
  misc_feature: GZ8MTXP02JK3CU.45.36.D03.1.454.CMB.2.raw
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccagtaggagtgtcagtaagtcttaggctggtaccaanagaaacctggccaggcctccgaggcctccncatccatgatgcatccaacgngggtcccctggccgtcccagaccgtacggttccccgtggccagtggggtctaggggacngggtcgttcacttcctacaccggtcaggcagcctggagcctgatgtatttgctagtttacttcgtgtcacgtcagtccgttccgccgtaccgcccgtcgtccgtaccggtttcggggacgggggtaccgtagggggtcggagacgtggacggacgtaacgtggagccgtgacaccgatcgtcgtactcg

SEQ ID NO: 346291 - DNA, 765 bp, Homo sapiens
  misc_feature: GZ8MTXP02G8HXV.45.36.D03.1.454.CMB.2.raw
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccgaggggacacacgccaccctctcctgcagggccaggtacggagtgtacagttaagtacgttaggcttaggaccaagacgaaacctggaccaggcctccgagcctccgtacactccagtgatcgacactacccgaagtaccgggtcctacggcccgtaccaaggtaccgtacggtacccgtggacctagggtcggtacgtacggggactacggtacgttaccaccgtttaccgaccgtaccggttacaacggacttaacccggcccgttagggaaccgtcccgttagtaattccgggttaaattttccgggtaccttaacgggtttttaccgttccttagttaaccgaacggtccgtaacgggttcccgggttacccctaccgtaacccggcccggttacccgttaaccggttaacccggggttttcccggggggaccgggggttaaaccccgttagggggtaccggagggtaaccgttacgggaacggaaccggttaacgtcggttacggaaccgttacggacccttaacccgtagtttccggtttaacctacgtttccccg

SEQ ID NO: 346292 - DNA, 853 bp, Homo sapiens
  misc_feature: GZ8MTXP02G5JOV.45.36.D03.1.454.CMB.2.raw
  modified_base (203)..(203): a, c, t, g, unknown or other
  misc_feature (203)..(203): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaaccggaaaattgtgttgacacagtctccaggccaccctgtctctgtctccgagggganacacgcccaccctctcctgcgagggccaggtaggagtgtacagttaagtacgttaggctacggtaaccaaacgagaaacccgtggacccgaggcctaccccgaggcctccctcactccatgatcgacactaccgaaacgtcgggtccctcgggcctcccgaaggtaccgtaacggggttcccggtggacccggtagggtacgggttccggtaggggacgtaacggtacgtttccgacttaccgtccgaaccgttcaacggcctaacgggtcccgtaggggaacccgtcccgttagggtaactttacgtttacgtttttcggaccgttttttaaacggttttaaccgtttccgtaggttttacccgaaacgggttcccggttaaaccgggttttccccggtttcccccgggaacccggggttaccccctccccccggggtttaccgtttaacccccggggttaccggggggtttttcccccggggggggaacccggggggttaacccccgggggttaaggggggtttaccggggaaaccgggtttagacgggggtaacgtaaaccgggttaaccgtgggggttacgacccgttaggaacccttaaccgtacgtttcccggtcgtttacctttaccgtaccggtttcccccg

SEQ ID NO: 346293 - DNA, 668 bp, Homo sapiens
  misc_feature: GZ8MTXP02GFWDI.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccaggggagacacgccaccctctcctgcagggccaggtaggagtgtcagtaagtacttaggctaggtaacccaagagaaacctggaccaggcctacccgaggtcctcctcatcccagtcgatcgcactcccgaaacgtacgggtcccctgggccgtacccagacgtacggttccggtggccctagggtcgggtcgtcggggacagttagtccacctctacgacccgtcgagccgaagtcccgttaggactcccgtgtagttcgttatttcggacttacggttttactcgtgtaccagtaccgtacggttccgttcccggacccgtaccgcccgtaccttccggtaacccggtttcgggggaccgggggtaccgtacgggggtagtaacgtacggttagaaaccgggtacgtaacgtcggttacgcgtcggaaccctacggtacttccgggttattacctttaccgcgtttcccccg

SEQ ID NO: 346294 - DNA, 708 bp, Homo sapiens
  misc_feature: GZ8MTXP02GNI9R.45.36.D03.1.454.CMB.2.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaacggaaaaattgtgttgacacagtctccaggcaccctgtctctgtctccgagggganacagcccaccctctcctgcagggccagtaggngtgtcagtaagtataggctaggtaccaanagaacngcagcnccagctccncanccatgatgacatacccgaacgtcgggtcccctgggccgtacccgaagtaccgtacgggtttccggtcgggaccgtacgggttcggggtacgtaggggaaccgtaaggtacgttccgaaccttccgtaccgtaaccggtccaaggtccaacggtcccgtagggaaaccgtccgtaggtaaacgttggttaaacgttttcggaacttttaacggttttacccttagtacggttacaaacggtccgtaacggttcccgttaccccgtaccgaacccgtcccgtcttaccggtacgggtttccgggggacgggggtaccgtagggggtaccgaaggtacgtaggaacggtaacgaacggttggtaccgggtctacggaaccctaacgtacgttccgtggtttaccttacgtacgtttcccccg

SEQ ID NO: 346295 - DNA, 643 bp, Homo sapiens
  misc_feature: GZ8MTXP02FHK8Z.45.36.D03.1.454.CMB.2.raw
  modified_base (203)..(203): a, c, t, g, unknown or other
  misc_feature (203)..(203): n is a, c, g, or t
  modified_base (626)..(626): a, c, t, g, unknown or other
  misc_feature (626)..(626): n is a, c, g, or t
  modified_base (632)..(634): a, c, t, g, unknown or other
  misc_feature (632)..(634): n is a, c, g, or t
  modified_base (637)..(643): a, c, t, g, unknown or other
  misc_feature (637)..(643): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggccaccctgtctctgtctccgaggganacacgcccaccctctcctgcgagggccaggtaggagttgtacaaacgtacgggttccggtaggctagggtcgggtaccgtggggaaccaggtagttccaccgtctaccgacccgtcaacggcacggtccctgggacgtcctgagttagtatttttcgcttaagtttaccttgtgtacagtcgtacgccccgtttcccgcctacgcccgtcgtccgtacgggtttccgggggaccgggggtacgtagggggtacggaacgtaggtagggaacgtaaccggtaacgttggtcggacgtacggacctacccgtatttccgtacgttcttacctcttacccgttccccgctaacttccgtgtaacgtcgtaccgtccggacgttcgagacgggtccgggtgacgggaccaagggtccacggttaaangactcnnngcnnnnnnn

SEQ ID NO: 346296 - DNA, 773 bp, Homo sapiens
  misc_feature: GZ8MTXP02HFEGW.45.36.D03.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaaattgtgttgacacagtctccaggcaccctgtctctgtctccgagggganacagccacctctcctggccacgggccaggtaggagtgtacagtaagtacttaggctaggtacaanagaaacctggaccagcctccgaggcctcctnactccatgatcgacactaccgaacgacgggtccctgggccgtacccaggaccgtacggtccgtaggccccgtagggttccggggtacgtcggggtaactacgggttacgttccgaaccgtttccgtaacccgtaaccggttccgaacggaccgtacgggtcccgttagggaacccggttcctagggtaaacgtttgttaaactttttcgggaccttttaaacgggttttccttcgtacggttacaacggtccgtacgggttcccgttaccccgccggttaacccggcccgtccgttaccggttaaccgggggtttccggggggaacccgggggttaaccgtaaggggggtggtaaaccgaggggttaaggaaccgggtaaacggttaaacgggttcgggtaaccggtcccgttgggaaaacccctcgttaacggggtaccctttacggtcccttttaaccgggactttcccccgg

SEQ ID NO: 346297 - DNA, 680 bp, Homo sapiens
  misc_feature: GZ8MTXP02HQ0ZS.45.36.D03.1.454.CMB.2.raw
  modified_base (203)..(203): a, c, t, g, unknown or other
  misc_feature (203)..(203): n is a, c, g, or t
  modified_base (339)..(339): a, c, t, g, unknown or other
  misc_feature (339)..(339): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgccaccctctcctgcagggccagtaggagtgcagtaagtacgttaggctaggtaccaacgaacgaaaccgtggaccaggcctcccgaggcctccgtacactccatgatcgacactaccaacgacgggtcccnggccgtaccagacgtcggtcgtggccgtaggtggtcgtgggactagtacgttccactcgtaccgaccgttgcgactacggccgttacgggacgtcccttggaacgttcgtttagttttacggacttttaaggttttacctgttacgtacgtaggtccgtacggttccgttccccgaccgacccggtcccgtcgttaccggtacgggtttccgggggaccgggggacgtagggggtacgtaacgaggttcgggaaaacgtcgggtaaacgttcgggacggtaaccttcggaaccttaaccgttcgttcgttaccggtttccttaacgttaccgtttcccccg

SEQ ID NO: 346298 - DNA, 631 bp, Homo sapiens
  misc_feature: GZ8MTXP02JAPRL.45.36.D03.1.454.CMB.2.raw
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccaggggagacagccaccctctcctgcgacggccagtaggagtgtacgaagtaagtacgttaggcgttacggaacccaacgaacgtaaaccgtcggaccaggtccaccgaagcctacctacactccatgactgacactaccaaacgcggtacccctggacctaccgaagaccgtaggtccgtaggcccgaggtggtcgaggacgaaggtactccgtactccgtaccgtaccgtcaacgcaacggcctggactccgtagtactgtatttcgattacgtttactcgtgtacacgacacgtcgtccgccgaccgtccgacttacgtcggttaccgggggacggggaaccgtgggggacgacgtagacgaacggaagaacgtggtaaggtctacggaacgaaacctagtttcggtcgttaacccttcgtaacgtttcccccg

SEQ ID NO: 346299 - DNA, 655 bp, Homo sapiens
  misc_feature: GZ8MTXP02IRSGL.45.36.D03.1.454.CMB.2.raw
  modified_base (204)..(204): a, c, t, g, unknown or other
  misc_feature (204)..(204): n is a, c, g, or t
  modified_base (260)..(260): a, c, t, g, unknown or other
  misc_feature (260)..(260): n is a, c, g, or t
  modified_base (640)..(640): a, c, t, g, unknown or other
  misc_feature (640)..(640): n is a, c, g, or t
  modified_base (642)..(646): a, c, t, g, unknown or other
  misc_feature (642)..(646): n is a, c, g, or t
  modified_base (648)..(655): a, c, t, g, unknown or other
  misc_feature (648)..(655): n is a, c, g, or t
tcagacgcgatcgacacgaccggtgctcgatttagctgcgtcacgatctctcttggggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcgacgggccaggtaggagttgtacaacgtaggtttccgngggccgtaggtcgggtctggggacaggagttcactctcaccgtcagcacgcctggacgcctgacttgtatttcgcttagttttcttcgtagtcgacgtacacggtccccgtttacccgcctaccggtcccgtactcccgttaaccggtttcggggggccggggggtaacccgtagggggtacggtacggtaagtcgggaaacggtacccgggaaagtttcggggtggtcccgttacggaccctaccgtaactttcgttaacggttttccttacccgtacgtttccccgttcccccggacttaccgttcttacggtacgttacccgtcgtccgtccggttcgtacgggcggttcgggcgtgggaccgaggggcccagtagngnnnnngnnnnnnnn

SEQ ID NO: 346300 - DNA, 685 bp, Homo sapiens
  misc_feature: GZ8MTXP02FGDNF.45.36.D03.1.454.CMB.2.raw
  modified_base (221)..(221): a, c, t, g, unknown or other
  misc_feature (221)..(221): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaccggaaaaattgtgttgacacagtctccaggcaccctgtctctgtctccagggagacacgcccaccctctcctgcngggccaggtaggagtgtacagtaatacgtaggcttggaccaacagaacctggcaggcctccgaggctccgtcacnccatgancgcanccgaaacgtccgggtccctcggccgtacccgacgtaaccgcgggttccggtggacccgtacggttggggacgtcgggaacctagtacgttccactccncgaccgtcacgcgacnccgtagcggtcctgtactggtaactttggtacttaaggtttccttcgtcgttacgacgccgttacggcccgttccccgacccgtacgccccgttacgtccgttaaccggggtttccccgggggaacgggggttaaccgagggggtaggaaccggaaggtttcggtaaaccggaacggtttaaaccggcggggttaacgtccggtaacgggccccgaaacggtactttaccggttacgtttccgtttaacccctacccgtcccg

SEQ ID NO: 346301 - DNA, 677 bp, Homo sapiens
  misc_feature: GZ8MTXP02JZUV4.45.36.D03.1.454.CMB.2.raw
  modified_base (204)..(204): a, c, t, g, unknown or other
  misc_feature (204)..(204): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaaccggaaaattgtgttgacacagtctccaggcaccctgtctctgtctccgagggganacacgccaccctctcctgcagggccagtaggagtgtacagtaagtcgttaggctaggtacccaagacgaaaccgtggaccaggcctcccgaggcctcctcactccatcgatgcatacccgaacgtacggggtcccctgggtcctacccgaaggaccgtacggggttccgtggccccgaggggttggggtctggggacaggtacgttccaactcgtaccgaccgtcgaacgcgacgtccgtagggctccgtagtgttagttagttttcgacgtttaaggtttttaaccttcgtcggttaccgtaaggtccgtacggtacccgggtttcccgacccgtacccgcccgttccggttacccgtacccgggtttcgggggaccgggggtaccgtagggggtcggtaggtagacggtaacgacggttaacgtggtcgggctaggccgaacctgtccgttcgtactttcgactttccccg

SEQ ID NO: 346302 - DNA, 697 bp, Homo sapiens
  misc_feature: GZ8MTXP02FGMNL.45.36.D03.1.454.CMB.2.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctntgtctccgaggganacagccacctctcctgccaggggccaggtacggagttgtacaggttaacgtacgtttaagggcttagggtaacccaaaacgtacggaaaaccctgggacccagggcctccccaagggccttccctacatcccagtcgatcgacatacccaaacgcgggttccccagggtccgtccccaaggaccgtagggtttcccgtggcctacgggtggggacttggggacagngtttccaccgtctccgaccgtnacgctagcccgttaggacgtccctaggtactggtactttgcgttaagtttttacctcttaggtaccaggtcacgttcgttacccgacctaccggtccccgaaccttcccgtaagggtttcccggggggacccggggggtaaacccgtggggttggggaaaacgtcgggttagaaaccgggaacggtaaccgtgggtacggtcctggaacccaccttgtccccgtagttccttaaccgctttcccccg

SEQ ID NO: 346303 - DNA, 672 bp, Homo sapiens
  misc_feature: GZ8MTXP02HXAZP.45.36.D03.1.454.CMB.2.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctgctcccagataccaccggaaaattgtgttgacacagtctccaggcaccctgtctctgtcctccgaggganacagcccaccctcncctgcagggccaggtagagtgtcagtaatcgttagcgtgtaccaanagaaacctggaccaggcctcccgaggcctccgtcatcccatgatcgctactaccaacggacggtcctcggctcccgagacgtcggttccgtaggctacggtcgggtctaggggactaggtacgttccactccgtcaacccgttnaccgnaccggtcgtaggccgtactgatgttatttcggacctttaggtttaacttcgtgtacctacgtctacgttcccgttcccgcccaaccgggtcccctaccgtccggttaacccggggtttccgggggacccgggggtaaccgcgggggttaaggaccggtaggttacggaaacggtacccggtaaacggttgggtaaccgccgttaaacgcccggtaaaacccgttacgttcccgttacgttcctttaccgttacccgttcccg

SEQ ID NO: 346304 - DNA, 815 bp, Homo sapiens
  misc_feature: GZ8MTXP02GTVJN.45.36.D03.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggtgtgtcacaagatttgggctctgggcaccgtgggcagtgggggagcgttgtccagcctgggagtccctgagactctcctgtgcagcctntggattctccctnagttaacttggttccacgtgggtccnccgtaggttccaggcgaaggggctgggaggtggggtcggccctntacgtttccggaaagagttagggaagtcggaaaggaacggtccctaaacgttcgaacggaaccgttccccggtaggaaaaccggggtcccctaccgtttaccaccccttacgtaccttaccccggaagtaaacggaaccccgtaaaactttaccccaaaaggtaaacttcggttaccctttcgttttttacgaacctaaaaagttggtaaaaccgttacgtaaacccgttaaaaggtagtttaacgggaaacggtaacccgtaaaccgttcgttagttcccgttaaagttttcccgtaggtttacggaccccggtaaagggggtccttaaaaggttccgttaaagtagggtaacgttcggtttagggtttaccgttaagttagtaaacgttctaaacgtacttaacctacgtacctagtacggtaacgtcggtaacggggaactaaacggggtacccttacggtccgtaaccgtccgtaccgtacgtacgtccgttacccgaccggtaacccgg

SEQ ID NO: 346305 - DNA, 694 bp, Homo sapiens
  misc_feature: GZ8MTXP02IT40N.45.36.D03.1.454.CMB.2.raw
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
  modified_base (622)..(622): a, c, t, g, unknown or other
  misc_feature (622)..(622): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggccaccctgtctctgtctccgaggggagacacgcccaccctctcctgcgagggcctaggtagggagtgtcagtaagtacttaggctaggtaccaanagaaacctggccaggcctcccaggtcctcctcgatccnttcgatcgacactcccgaaagaccggggtacccctgggccctaccccgaaggtaaacccgtcggggtttccccccgtgggccgtacggttggggtaccgtaggggtaccagggtcggtttaccaccgttcctacccgaaccggtcaaagccgacgtcccgtagcgccgttagaacttgttcttttacgaccgtttagtttaccctttgtcgttacgtaacgtcgtaaccggttccggttacccctccgaccgccgtcctaccggtacgtttccgggggcgggggtacccgtagggggtcgaagnggttacgaacggtacgtaacggttggacggtcgtacgaccgaacgttcgtaccgtttcgtccggttttcccg

SEQ ID NO: 346306 - DNA, 648 bp, Homo sapiens
  misc_feature: GZ8MTXP02FHXMF.45.36.D03.1.454.CMB.2.raw
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
  modified_base (541)..(541): a, c, t, g, unknown or other
  misc_feature (541)..(541): n is a, c, g, or t
tcagacgcgatcgacacgaccggtgctcgatttagctgcgtcacgatctctcttgggggccctggggaggaactgctcagttaggacccagagggaaccatggaagcccccagctcagcttctcttcctcctgctactctggctcccagataccaccggaaaaattgtgttgacacagtctccaggcaccctgtctctgtctccgaggggagacagcccaccctctccgtgcgagggccagtaggagtgtacagtaagtacttaggctacggtaccaacgacgaaacctggaccgaggcctacccgaggcctactcatcccagtcgatcgacacgtaccccaacgtacggggtccctacggggcccgttaccccgaaggtaccgtacggggttcccccgtagggaccgtagggttcggggtcgtaggggaaccagggtacgttccacttccgtaccaccggtcacgtcgacggcccgtggacgcctgactgttatttcgngttacgtttacttacgtgtacncggtacacgtccggtcccncccgtaccgcccgtctacgtaccggttcggggacgggggtaccgagggggtcgagagtcggaggaccgtactcggtagccgtgaccctacgactcgtcgtaccttcg

SEQ ID NO: 346307 - DNA, 625 bp, Homo sapiens
  misc_feature: GZ8MTXP02GYIOZ.45.36.D03.1.454.CMB.2.raw
  modified_base (202)..(202): a, c, t, g, unknown or other
  misc_feature (202)..(202): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
  modified_base (546)..(546): a, c, t, g, unknown or other
  misc_feature (546)..(546): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcacgggccagtaggcgtgtacaggtaagtacttaggctacggtaaccaacacgaaacctggaccaggtcctcccgaggcctacctcactccatcgaatcgactactacccaaaacgtcgggtccctcgggtacctcccgagaccgtacggttccggtggaccccgtaggtcggttcgaggggacctaggtacttcgacttctaccgacccgtnacgacncgacccgtggacgtcctgactgttaatttcgactttagtttactcgntacgtagcctagtccgttacccncgaccgcgtcgtacggtacgggtccggggacggtacgnggggtagacgtagtacggaacgtacgtacgtcgtacgctagcccgtacgtacgttcgtacgttcctactaccgttcccg

SEQ ID NO: 346308 - DNA, 711 bp, Homo sapiens
  misc_feature: GZ8MTXP02GBY00.45.36.D03.1.454.CMB.2.raw
  modified_base (203)..(203): a, c, t, g, unknown or other
  misc_feature (203)..(203): n is a, c, g, or t
  modified_base (681)..(681): a, c, t, g, unknown or other
  misc_feature (681)..(681): n is a, c, g, or t
  modified_base (689)..(689): a, c, t, g, unknown or other
  misc_feature (689)..(689): n is a, c, g, or t
  modified_base (702)..(702): a, c, t, g, unknown or other
  misc_feature (702)..(702): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgcccaccctctcctgcgacgggccaggtaggagtgtacaaggttaacgtacgttaggcgtaggtaaccaacaacgaaacctggacccaaggcctacccgaggtcctcctacactccatgatgcactaccgaacgtaccgggtccctcgggacccgtcccgaagaccgtacggggttccgtgggccccgtaggggttcggggtccgtaggggactacggttacgttcctaccgtccgtaccgtacccgtacgacggccgtacggcccgtaggggaccctaccgtaggtattcgtttatttccggacttttaacggtttcttaccgtgtaccgtagtccgtagttccccgtacccgacccgtccggaccccgtcttaccgggttcgggttacccgggggccgggggtaacgtcgggggttagaacgggtacgtagggaacgtaccggaagtcggtcggacgtcgaacgttaccggnttcggttntaccgtttaccgntttcccccg

SEQ ID NO: 346309 - DNA, 756 bp, Homo sapiens
  misc_feature: GZ8MTXP02J2B1U.45.36.D03.1.454.CMB.2.raw
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
tcagacgcgatcgacacgaccggtgctcgatttagctgcgtcacgatctctcttgggggccctggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccaggtacggatgtacagtaagtcttaggctaggtaccaanacgaaaccgtgaccaaggcctcccgaggcctcctacatcccattgatcgacactacccgaacgtacgggtcccctggtcccgtccgaagtacgtacgggtttccccgagggtcctaggtcggggtcgtaggggactggtacgttctacgtctccgaccgtcaacgccaacgttcccgaagggacgtacccgttgtacggttttaccgtagtttttcggaaccgtttttaacggttttccctagggttacgttaaaccccggacggttacccgttaccgggttacccccggttacccccgacccgttaccccggttcccgttacccggttaccggggtttacccggggttaccgggggggacccgggggttaacgtaagggggtacggtaacggtacggtaaccggggtaacgtaaaccgggttcgtcgggtaccggtcgtacgtacccgtacgttacgtttaccgttacgttcctttaacccg

SEQ ID NO: 346310 - DNA, 654 bp, Homo sapiens
  misc_feature: GZ8MTXP02INPAX.45.36.D03.1.454.CMB.2.raw
  modified_base (207)..(207): a, c, t, g, unknown or other
  misc_feature (207)..(207): n is a, c, g, or t
  modified_base (372)..(372): a, c, t, g, unknown or other
  misc_feature (372)..(372): n is a, c, g, or t
  modified_base (472)..(472): a, c, t, g, unknown or other
  misc_feature (472)..(472): n is a, c, g, or t
  modified_base (558)..(558): a, c, t, g, unknown or other
  misc_feature (558)..(558): n is a, c, g, or t
  modified_base (568)..(568): a, c, t, g, unknown or other
  misc_feature (568)..(568): n is a, c, g, or t
tcagacgcgatcgacacgaccggtgctcgatttagctgcgtcacgatctctcttgggggaggaactgctcagttaggacccagagggaaccatgggaagcccccagctcagcttctcttcctcctgctactctggctcccagataccaaccggaaaaattgtgttgacacagtctccaggccaccctgtctctgtctccgagggganacacgcccaccctctcctgcagggccaggtaggagtgtctagtaagtacttaggctaggtaaccaagaacgaaaccgtggacccaggcctccccgaggtcctaccgtccatccgaatgatcgccataccaaacgtcgggtccctggcctcccagactcggtccgngtccgaggtggtcgtggactagtacgtcactctcaccgtcacgtccacggtcgtaggacgccgtgtacgtgtttaagttttcgactttaacgtttccttntcgttaacgcgtccgtacggtccgttacccgcccgtacccgcccgtcttaacccggttcggggtccgggggaccggggtaccgggnggtaggtagnggttaaggacccgaacggttaagtcgggtacgttccgaggcccctagtaaccggttctccgttaccttaccgtctttaacccccgg

SEQ ID NO: 346311 - DNA, 773 bp, Homo sapiens
  misc_feature: GZ8MTXP02IZIOE.45.36.D03.1.454.CMB.2.raw
tcagacgcgatcgacacgaccggtgctcgatttagctgcgtcacgatctctcttgggggccctgggggaggaactgctcagttaggacccagagggaaccatggaagcccccagctcagcttctcttcctcctgctactctggctcccagataccaaccggaaaaattgtgtgacacagtctccaggcaccctgtctctgtctccgaggggagacagcccaccctcctcctagccgacgggccaggtaggagtgtacaggtaagtacgttaggctacggtaccaaacgacgaaaccgtcggaccagggccctccgaggtcctcctcactccagtacgatcgacctctaacccgtaacggacccgggttccccgtaggggaccccgttaccccgaaggtaccggtaccggggtttaccccggtgggaccgtgggttacggggttcggacggggaactgggggttaaccttcgaccgtttaccgaccgtaccgggtccacggtacccacgggtcccgtagggaccgtacccggttagttagttacgtttagttttaccgtacgtttacgttcgtttccgtacggttagacggttccgcggtttacccgggacccccgtcccggtcccggtccgttacgggttacgggttacccgggggtaccgggggaccgggtacgggtacgggtacgggtagtacgggtacgacggttaaccgggtcgtacgggtacgtaaccgaccgtaccgtacgtccgtttacgttacgtttaccgtccg

SEQ ID NO: 346312 - DNA, 612 bp, Homo sapiens
  misc_feature: GZ8MTXP02FWE26.45.36.D03.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (355)..(355): a, c, t, g, unknown or other
  misc_feature (355)..(355): n is a, c, g, or t
  modified_base (541)..(541): a, c, t, g, unknown or other
  misc_feature (541)..(541): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaattgtgttgacacagtctccaggcaccctgtctctgtctccgagggganacacgccaccctctcctgcgagggccaggtaggagtgtcaagtaagtacttaggctggaaccaanagaaacctggcagcctccnggcctcctnatccatnatgctatccaaacgtcgggtcccctgggccgtaccgaggtaccagggttccgnggccgtagggtgggtcgtaggggacctaggtacgttccacgtctacgtaccgtcagcacgtcctgggacctctagattgttacgtttcgtacgttaagtttctctgttacgcggctacggttccgtccggacccacggtccccgtgtaccgttacggggttcggggggacccgggtagagggggtntaacggtaggtaggaacggtacgtacggtcggtcggactacgcctacgtctcgtcttccgtactacgtccc

SEQ ID NO: 346313 - DNA, 684 bp, Homo sapiens
  misc_feature: GZ8MTXP02GP63W.45.36.D03.1.454.CMB.2.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccagggganacagccaccctctcctgcagggccaggtaggagtgtacagtaagtactaggctggtaccaanagaaacctggaccaggcctccccgaggcctcctcactcccatgatgacatacccagtacgggtccctggccgtacccgagtacctaggggttcccgtggaccgtagggttcgggtcgtaggggacaggtacgttccgaccttcgtaccgtacccgtgaacgcacggtacctgggaccgtccgtgacgttagttattttcggacctttaacggttttacccttgttacggtactacgtaccgtacggttacccgttccccgcccgaaccgtccccgtaccgttccgtaacccgggtttccggggggaccgggggtaccctaggggggtcgtaaacggtaggtacggtaaacggaccgtaaacggttgaccgggcttacggccaccttaacgtcggttacgttcccttagtccgtttacccg

SEQ ID NO: 346314 - DNA, 646 bp, Homo sapiens
  misc_feature: GZ8MTXP02IPU20.45.36.D03.1.454.CMB.2.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacacgccaccctctcctgcagggccaggtaggagtgtcaagtagtactaggctggtaaccaacagaaacctggccaggcctcccgagctccncactccatgatgcactccaacgtcgggtcccctggccgtcccaggtaccgacgggttcccgtaggccctagggtcggggtctaggggactaggcgttcgactctaccgaccgtcagcacgccgtggacgtccgtgactgttatttacggctttaagtttcttgtcgtactacgcgtacggtccgttaccccgccgtacccgcccgtccgtaccggtaccggtttccgggggacccggggggtaccgtagggggtacggaacggttaggtacggtaacgggaccgtaaacggtgggttacggccgttacggcccaacgtacttcgttacggtcctttactaccgtttccccg

SEQ ID NO: 346315 - DNA, 602 bp, Homo sapiens
  misc_feature: GZ8MTXP02IL1KX.45.36.D03.1.454.CMB.2.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
tcagacgcgatcgacacgaccggtgctcgatttagctgcgtcacgatctctcttgggttttggggggaagaggaagactgacggtcctcccaggagttcaggtgctgggcaccttgggcacgggggaggcgttgtccagcctgggaggtccctgagactctcctgtgcagcctctggattctccctnagttaactttggtttccactgggtccnccaggttccaggcaaggggctggagtgggtgccctnattcgaagntggaagtgagaaggcctactcagactccgtgaaggccgcttcaccatctccagagacaattccaanaatgtcctcttttgcaaatgaatagctaganagttgagcacgtctgttctatttctgttgtccagggggtacaagttctatgagttcgtaggttcgtagtgtaatctaactactactacctacaatggacgtcgtggggacgtaaaacgggacctcggtacaacccggtcgtcccgacacgtcctttaccaccgaaacggggtccccaacgtaccggtcccgtttcccccgtcggtccgccccgtcgtcccgtccacggtaccgccaccgttccggg

SEQ ID NO: 346316 - DNA, 689 bp, Homo sapiens
  misc_feature: GZ8MTXP02HCY94.45.36.D03.1.454.CMB.2.raw
  modified_base (268)..(268): a, c, t, g, unknown or other
  misc_feature (268)..(268): n is a, c, g, or t
  modified_base (348)..(348): a, c, t, g, unknown or other
  misc_feature (348)..(348): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctccagataccaccggaaaattgtgttgacacagtctccaggcaccctgtctctgtctccgagggagacagccaccctctcctgcagggccaagtaggagtgtcagtaagtacttaggctggtacaacagaaacnggccaggctccagcctctcatccatcgatgacaacgtacccgaacggtcgtcgtacggcctacgacgacgttacggtcgnggaccgtgggtacggtcgtacgggactaggttactcctaccgtctaccgtaccgacgacgacgtaccgtcgtacggcccgtacgtacgttaggtaagtttttcttacggtacttttaaccgtttactcgttcgtacgtcgtacgttaccgttcccgaccgacccggtacgtccgttacgtaccgggttaccgggggtaccgggggaccggggtacggtacggggtaacgtaacgggtacgggtaacgtaaaccggtaacgggttacggtcggggtcgtacgtacccgtaacgtaaccggttccgttacgtttcccgttaccgttaccgttcccgttccccg

SEQ ID NO: 346317 - DNA, 639 bp, Homo sapiens
  misc_feature: GZ8MTXP02G6S9L.45.36.D03.1.454.CMB.2.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (565)..(565): a, c, t, g, unknown or other
  misc_feature (565)..(565): n is a, c, g, or t
  modified_base (581)..(581): a, c, t, g, unknown or other
  misc_feature (581)..(581): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaccggaaaaattgtgttgacacagtctccaggcaccctgtctctgtctccgagggganacagccaccctctcctgcagggccaggtaggagttgtanaagtaagtacttaggctacggtaaccaaacaggaaaccctggacccgaggcctacccgaggtcctcccgacactccaatgatcgacactacccaacgcggtccctgggcctcccaggacgtacggttccgtggaccgtacggtgggtcgtaggggactagtacgttccaccttccgtccgaaccgtcaacgtcgacgtccgtggacccgtctggaatttgtaatttcgacttaacgttttctcgtgttaccaggtcctacggttccgtaccccgcgtaaccgcccgtacgtaccggtcggtttcccgggggacggggtaacgnggggtacgacgtaagnggtaacgacggagttcggtcggctgaaccgtacgtgtcctgtactcgactttcccccg

SEQ ID NO: 346318 - DNA, 617 bp, Homo sapiens
  misc_feature: GZ8MTXP02GYTN0.45.36.D03.1.454.CMB.2.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (426)..(426): a, c, t, g, unknown or other
  misc_feature (426)..(426): n is a, c, g, or t
  modified_base (557)..(557): a, c, t, g, unknown or other
  misc_feature (557)..(557): n is a, c, g, or t
  modified_base (571)..(571): a, c, t, g, unknown or other
  misc_feature (571)..(571): n is a, c, g, or t
  modified_base (591)..(591): a, c, t, g, unknown or other
  misc_feature (591)..(591): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctcccagataccaacggaaaaattgtgttgacacagtctccaggccaccctgtctctgtctccgagggagacncgcccaccctctcctgcgagggccagtaggagtgtctagtagtatagctacggaacaacagaacctggccaggctaccgagcctcncgatccatnatgcaagtacccaaagtccgggtccctagggcccgtcccaagacgtaccggttcggtagccccgtaggtcggtcggtggacgtagtactcgaactccgtaccgtacacgacgctacggctgggacnccgttagcttagggtattttcggacgtttaacgttaccgtcttacgtacgacgtacgtaggtcccgttacccgaccgaccgtccgtaccgttcgtaccgggttccgggacgggggtaccaaggggtcgganaggtacgacggtanacgggttgcggtactcgaanactcgtgtcctacgtctacgttcccg

SEQ ID NO: 346319 - DNA, 772 bp, Homo sapiens
  misc_feature: GZ8MTXP02IE2NO.45.36.D03.1.454.CMB.2.raw
  modified_base (200)..(200): a, c, t, g, unknown or other
  misc_feature (200)..(200): n is a, c, g, or t
  modified_base (411)..(411): a, c, t, g, unknown or other
  misc_feature (411)..(411): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccacggaaaattgtgttgacacagtctccaggcaccctgtctctgtctccgaggganacacgcccacctctcctgcgagggccaggtaggagtgtctaaggtaagttacgttaggctacggtaacccaacgaacgtaaaccgtcggacccgaaggcctaccccgaggcctcctaccgactcccagttcgattcggacctaacgtacccgaaaacggtaccggggtcccctagggccctaccgaagggtaccgttacggggttcccggnggtcccgtaacggggttcggggtaccgtacggggtaacacgggttacgttacccgtaccgttaccgtacccgtaaccccgttcgaaccgacgtaaccgggtccgtaacggggcgttacccgtaggtaagttaccgtttagtttcgactttacggtttaaccttcgttacgttacacggtctacggttccgttaccgccgtaacccgccgtacttcccgggtacgggttacccgggggacggggtaccggtaggggtacgggacgtaggtacggaacggtaacgttacggtacggtcggtaactcgggaaccctaaccgttacgttccggttccgtttcgttaaccttaccgtttcccccgg

SEQ ID NO: 346320 - DNA, 750 bp, Homo sapiens
  misc_feature: GZ8MTXP02HK22C.45.36.D03.1.454.CMB.2.raw
  modified_base (204)..(204): a, c, t, g, unknown or other
  misc_feature (204)..(204): n is a, c, g, or t
  modified_base (706)..(706): a, c, t, g, unknown or other
  misc_feature (706)..(706): n is a, c, g, or t
  modified_base (739)..(739): a, c, t, g, unknown or other
  misc_feature (739)..(739): n is a, c, g, or t
tcagacgcgatcgacacgaccggtgctcgatttagctgcgtcacgatctctcttgggggaggaactgctcagttaggacccagagggaaccatggaagccccagctcagcttctcttcctcctgctactctggctcccagataccaacggtaaaaattgtgttgacacagtctccaggcaccctgtctctgtctccgagggganacacgcccaccctctcctgcgacgggccaggtaggagtgtactaagtaacgttacgttaggctacggtaaccaaacgaacgaaaccgtcggaccgaacggtcctccccgacggccttcccacactcccaagtcgtactcgtccaacgtaccccgtaaaccgtaccggggtccccgtccgggaccgtccccgaaggaccgttagggttccggtcgggaccgtacggggtcggggtacgtacggggaccgtaggtacgtttccgaccgttacctaccgtacccgacgacgacgtaccgtccgtagggccctcgtaggtaagttcggttactttgacgtttaacgttttaccttcgtagttaccggtaacgtcggttacggtcccggttccccggccctacccggtcccgttaccgttacccggtttaccgggggtttcgggggaccgggggaacgtagggggttacgaggtaacggttgaaacgggtacggtagttcgggcgtntaccggaactaccgtatccgttgttaccccttntaccgtttccg

SEQ ID NO: 346321 - DNA, 724 bp, Homo sapiens
  misc_feature: GZ8MTXP02JEJ7W.45.36.D03.1.454.CMB.2.raw
  modified_base (201)..(201): a, c, t, g, unknown or other
  misc_feature (201)..(201): n is a, c, g, or t
  modified_base (329)..(329): a, c, t, g, unknown or other
  misc_feature (329)..(329): n is a, c, g, or t
tcagacgcgatcgacacgaccggtgctcgatttagctgcgtcacgatctctcttggggaggaactgctcagttaggacccagagggaaccatggaagccccagctcagcttctcttcctcctgctactctggctccagataccaccggaaaattgtgttgacacagtctccaggcaccctgtcctctgtctccgagggganacacgccaccctctcctgcgaggcctagtacggagtgtcagtaagtacgtaggctgtacaacagaacctggccaggctcccgaggctcctcgatccatcgatcgcacgtccaaagtcggggttacccncgggtccgtacccgaggtaacctcggggttacccggtggcccgtaacggttcggggtactcggggaacgtaggttaacgttccggtctccctccgtacccgtctaacggccgaacggtccgtactacgggggggggccctacggtacgttagttagttttagtttagtttaacgtttacgttcgtactaggtaccgtacgtccggttcccgtaccgccgtacccgtccgtcccgttaccggttaccgggggtaccgggggtaccgggtacgggggttacgggaacgggtacggttacggacggggtaaccggtaacggttacgggtcggtaaccgtcgtaccgtaaccggtaaccttacgttcggttccttaccgttaccgtaccggtttccccg

SEQ ID NO: 346322 - DNA, 633 bp, Homo sapiens
  misc_feature: GZ8MTXP02FOMVP.45.36.D03.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
tcagacgcgatcgacacgaccggtgctcgatttagctgcgtcacgatctctcttgggggaggaactgctcagttaggacccagagggaaccatggaagcccccagctcagcttctcttcctcctgctactctggctcccagataccaccggaaaaattgtgttgacacagtctccaggcaccctgtctctgtctccagggganacagcccaccctctcctgcagggccagtaggagtgtcagtaagtactaggctggtaccaanagaactggccaggctccagctccncatccatgatcgacactcccgaacgtacgggtccctgggccgtaccccaagtaccgacggttccgtggacccgagggtggtacgtggggaacaggtacgttccaacgtcctacgtacccgtcacgtcacgtccgtggacgcctgatgtactttgacttagttttactcgtgtacgacgacgtacggtccgttccccgacccgtaccgtcccgtaccttaccggtacgtttcccgggggacgggggtacccgaagggggttcgaacggtagtacggaacgtaacggtaacggtggtacggtacttacggaacctaccgtacttcgttcgtaccttcctacttcccg

SEQ ID NO: 346323 - DNA, 543 bp, Homo sapiens
  misc_feature: GZ8MTXP02F4YX9.13.74.G08.1.454.CMB.2.raw
  modified_base (261)..(261): a, c, t, g, unknown or other
  misc_feature (261)..(261): n is a, c, g, or t
  modified_base (379)..(379): a, c, t, g, unknown or other
  misc_feature (379)..(379): n is a, c, g, or t
tcagtcacgtactacacgaccggtgctcgatttagtagctctatcaggggagctctgggagaggagccccagccctgagattcccaggtgtttccattcagtgatcagcactgaacacagaggactcaccatggagttgggactgagctggattttcctttggctattttaaaaggtgtccagtgtgaagtgcagctggtggagtcgtgggggaggcttggtacagcctggcaggtccctgagactctctgtgcagcctcnggattcattctttgatgattatgccatgcacgtggggtccggacaagcctccgaggggaacgggcctaggggagttcgggtctaccgtaggttagttaggttaggaataggtagtacngtaggctagtgcggatcgtgtaggaggcctatcacctatcctacgagacgacaacgactaaacgaacctccgtatatctagacaaagtgaacagtcagagacgctaggacgactacggtcttagtactgtgtaacgactaaacggttcatttacgactaggtcg

SEQ ID NO: 346324 - DNA, 619 bp, Homo sapiens
  misc_feature: GZ8MTXP02IGVQB.13.74.G08.1.454.CMB.2.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (568)..(568): a, c, t, g, unknown or other
  misc_feature (568)..(568): n is a, c, g, or t
tcagtcacgtactacacgaccggtgctcgatttagtagctctatcagggggagctctgggagaggagcccccagccctgagattcccaggtgtttccattcagtgatcagcactgaacacagaggactcaccatggagttgggactgagctggtattttccttttggctattttaaaaggtgtccagtgtgaagtgcagctggtggagtcgtgggggaggcttgggtacagcctggcaggtccctgagactctcctgtncagcctntggattcatctttgatgattangccatgcacgtgggtccgnaagctcgaggggaggcctggagtgggtctcgaggttattaggttaggaattaggtggtacagttaggcttatgggcgtactcgtgtaggacggggtcctagttaccactacgtcccgtacaaggaacgaaaccgaaccggtacccaaaacggtaacccttaccccgtagttaactcgtagaacctaaaagttcgaactaacgtcgtaggaaggtacgtcgtagggacgtaacgaccgggtaccctttaggtaactttacgngtaacgaaacgtaaaacggttccctaaaagttttccggacgtaggttcggg

SEQ ID NO: 346325 - DNA, 677 bp, Homo sapiens
  misc_feature: GZ8MTXP02GXE04.13.74.G08.1.454.CMB.2.raw
tcagtcacgtactacacgaccggtgctcgatttagtagctctatcaggggagctctgggagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggagtcttgggtacagcctggcacggtccctgagacctctcctgtcgcacgcctcgtggattcattctttgatgtattatcgcctatcgacctacggtcggggtccccggacaaacggtcccgtaccgggaaggggaacgggtcccgtggggtaggtcggggtcctaccgtaagggttagttaggttaggtaaacttaggtaacggtacaggttaggcttagtcgggacggtacttcggtagttggaaaccggggcctacttaccgaccctagttcccacgaagaacaaccgaaccgaaccgaaagtaaccctcccttaagtacctactacgaactaaaagttacgaaacgtacgtacgtagaaggtacgtaccggtagggaaaccgtaccggaccgttaccgtttacggttattacgttagaacgtaaacgaaaacggttctaagttacgccgtaggttcgg

SEQ ID NO: 346326 - DNA, 526 bp, Homo sapiens
  misc_feature: GZ8MTXP01AX53M.21.65.F10.1.454.CMB.2.raw
  modified_base (291)..(291): a, c, t, g, unknown or other
  misc_feature (291)..(291): n is a, c, g, or t
  modified_base (352)..(352): a, c, t, g, unknown or other
  misc_feature (352)..(352): n is a, c, g, or t
  modified_base (398)..(398): a, c, t, g, unknown or other
  misc_feature (398)..(398): n is a, c, g, or t
  modified_base (499)..(499): a, c, t, g, unknown or other
  misc_feature (499)..(499): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccacctctcctgcagggccagtcagagtgttagcagcaacttagcctggtaccagcagaacctggccagcctccaggctcctcatctatggtncactccgcagggccatggaactcccagccaggttcagtcggcacgtggggtctaggggacnggtagttccactctcacctatccagcagcctgctagtctagaagtnttttaggaatttattctagttctgctagtacaatcgagtcggcctcggacgttcggaccgtaagggaaccaagggttgaaacttcgaaacgtaacgttggnggctgcaaccatcttacgtcttctaac

SEQ ID NO: 346327 - DNA, 553 bp, Homo sapiens
  misc_feature: GZ8MTXP01CM0GI.21.65.F10.1.454.CMB.2.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgtagcagcaacttagcctggtaccagcagaaacctggccagccctccaggctcctcatctatggtncatcccgcagggccagtggaactcccagccaggttcagtggcacgtgggtctgggacngtagttcacttccncaccatccagcagcctgctagtctagtaatatttagtaattttnttcgtgttcgtntactataactatcgtacggtcgtaccgtacggtacgtacggaacggaaacgggtaacgtaaaggttaagtaaacaacgtaaacgtacgttggttcgactgacctaacgtcgttcgttcttcgttcgtaacg

SEQ ID NO: 346328 - DNA, 507 bp, Homo sapiens
  misc_feature: GZ8MTXP01DZU32.21.65.F10.1.454.CMB.2.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
  modified_base (493)..(493): a, c, t, g, unknown or other
  misc_feature (493)..(493): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgttagcagcaacttagcctggtaccagcagaaacctggccagcctccaggctcctcatctatggtncatccgcagggccacgtggaactcccagccaggttcagtggcacgtgggtctaggggacnggagttcactctcacatcagcagcctgcagtctgaagtatttgaagtttattctgttctgctagtacaatcagtggacctggtacgttcgcgagggaacaaggttggaaattcgaaaacgtacttggttgctgcaaccntcttgtcttctaac

SEQ ID NO: 346329 - DNA, 577 bp, Homo sapiens
  misc_feature: GZ8MTXP01EQ7PY.21.65.F10.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (426)..(426): a, c, t, g, unknown or other
  misc_feature (426)..(426): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgtagcagcaacttagcctggtaccagcaagaaacctggccagccctccagctcctnatctatggtncactcccgcgacgggccacgtggaactcccgagccgtaggttcacggtcggctacgtggggtctaggggacaaggtacgttcactctacacctatcagcaggcctgccagtctagaagttatttagaagtttnttctgtctgactagtactaatcgtaggtggcccttacgggtacgttccgggaaccgtaaggggaacctaaagggttaggaaaacttaccgaaaacgtaacgttggttcggttactggacctaacgtacttcgttacgttctttctaacccg

SEQ ID NO: 346330 - DNA, 581 bp, Homo sapiens
  misc_feature: GZ8MTXP01DW9D3.21.65.F10.1.454.CMB.2.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagccctggtaccagcagaaacctggccagcctcccaggctcctcatctatggtncatccgtcagggccactggaactcccagccaggttcagtggcacgtgggtctggggacnggtagttcacttctcaccatcagcagcctgcagtctagtaagtattttagaaagtttttntttcttgttcgttgtacgtaagtaactaatcgtaggttcggtaccgtcggtaccgttaccgggaccgaaaggggtaaccgtaaagggttacggtaaaacgttaccgaaaacggtacgttaggttcggacgtaacgacctaacctatcgttacgttccttcgtaaccg

SEQ ID NO: 346331 - DNA, 511 bp, Homo sapiens
  misc_feature: GZ8MTXP01EUAWO.21.65.F10.1.454.CMB.2.raw
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgtagcagcaacttagcctggtaccagcagaaacctggccagcctccaggctcctcatctatggtncatccgcagggccacgtggaactcccagccaggttcagtcggcacgtgggtcnggggaacagngttcactctcaccatcagcagcctgcagtctagaagttattttgaagtttattctgtctggctagtacaatcagtcgctcggacgttcgaccgaagggaccaaggtgaaatcaaagactggcggcttacgcacctaagtctgttcttcaacgtccc

SEQ ID NO: 346332 - DNA, 504 bp, Homo sapiens
  misc_feature: GZ8MTXP01C86M4.21.65.F10.1.454.CMB.2.raw
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (403)..(403): a, c, t, g, unknown or other
  misc_feature (403)..(403): n is a, c, g, or t
  modified_base (488)..(488): a, c, t, g, unknown or other
  misc_feature (488)..(488): n is a, c, g, or t
tcagtcgtcgctcgcacgaccggtgctcgatttagctacgctctaaggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctccaggcctcctcatctatggtncatccgcagggccactggaactccagccaggttcaggtggcagtgggtctaggggacnggagttcactctcaccatcagcagcctgcagtctgaatattttagaagtttnttctgtctgctagtacaatcagtcggacctggtacgttcggcaagggaaccaaggttggaaattcgaaagacttgttggctgacnccatcttcgtcttctc

SEQ ID NO: 346333 - DNA, 569 bp, Homo sapiens
  misc_feature: GZ8MTXP01DB6TT.21.65.F10.1.454.CMB.2.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (432)..(432): a, c, t, g, unknown or other
  misc_feature (432)..(432): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctaggtaccagcagaaacctggccagccctccaggctccnatctatggtncactccgcagggccacgtggaactcccagccaggttcaggtcggactacgtggggtctaggggacaaggtacgtttccacttcctaccaaccatcagcacgcctgcagtctagtaagttattttagtaaagttttnttctgttcgtagtactaagtactatcgtaggtcggtccgtcggtacggttcggaccggaaagggaacgtaagggttacgaaacttacgaaacggtgttggttcggactcgactaactatcgttcgttccttctaacg

SEQ ID NO: 346334 - DNA, 514 bp, Homo sapiens
  misc_feature: GZ8MTXP01DMJBM.21.65.F10.1.454.CMB.2.raw
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctccaggctcctcatctatggtncatccgcagggccatggaactcccagccaggttcagtggcacgtgggtctaggggacngagttcactctcaccatcagcagctgcagtctgaagtntttgaagtttattctgtctgctagtacaatcagtcggacctcggtcgttcggaccgaaggggaacccaaagggttggaaacttcgaaaacgacgttagttggctgacaaccatcttgtcttctaac

SEQ ID NO: 346335 - DNA, 604 bp, Homo sapiens
  misc_feature: GZ8MTXP01CRFHG.21.65.F10.1.454.CMB.2.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctggtaccagcaagaaacctggccagccctccaggcctccnatctatggtncactcccgcagggccacgtggaactcccagcctaggttcacggtcggacacgtggggtctaggggaacnggtacgttcacttctaccaccatcagcacgcctgcctagtctagaagttattttagaagttttattctgttctagtactaagtactaatccgaggttcggtacccgtcgggtaccgttacgggacccgaaagggggtaaccctaaaggggttacggtaaaacaccggtaaaaacggtcgttagggttcggaccgtaaggacctaacccgtagttccttcggtttccttcgttaacccg

SEQ ID NO: 346336 - DNA, 589 bp, Homo sapiens
  misc_feature: GZ8MTXP01DNST2.21.65.F10.1.454.CMB.2.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (420)..(420): a, c, t, g, unknown or other
  misc_feature (420)..(420): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtagcagcaacttgcctggaccagcagaacctggccagcctcccaggcctcctcatctatggtncactccgccagggccagtggaactcccgagccaggttcaggtcggcacgtggggtctagggaacnggtacgttcactctacaccatccagcagcctgcagtctagaagttattttaggaaattttnttctgttcgtgtactaagtaactaatcgtaggttcggcccgtcgggtaccgttaccgggaacccggaaagggtaaccgtaaagggttaagaaacgttaaacgaaaaccgtaacgttggttcggactaacggacctaaccgtacgttaccttcgttccgttaacgtaacg

SEQ ID NO: 346337 - DNA, 515 bp, Homo sapiens
  misc_feature: GZ8MTXP01BNURY.21.65.F10.1.454.CMB.2.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
  modified_base (496)..(496): a, c, t, g, unknown or other
  misc_feature (496)..(496): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcaagaacctggccagcctcccaggctcctnatctatggtncatccgcagggccacgtggaactcccagccaggttcagtggcagtgggctgggacngagttcactcncacatcagcagcctgcagtctagtaagtatttgaaatttnttctgtctgtcagtacaatcagtggcctcgggtacgttcggacgaaggggaaccaagggttaggaaattcgaaacgaacttggttcggctggacnctatcttgtccttgtaacc

SEQ ID NO: 346338 - DNA, 563 bp, Homo sapiens
  misc_feature: GZ8MTXP01DY3IT.21.65.F10.1.454.CMB.2.raw
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgtagcagcaacttagcctggtaccagcagaacctggccagcctccaggctcctcatctatggtgcatcccgcagggccacgtgaactccagccaggtcagtcgcagtggtctgggaacagngttcactctcaccatcancacgcctgcagtctagtaagttattttagaagttttattcttgttctggtactagttaacaatcgagtcggccgttacgggtaccgttccggaccgaaacggggaccgaaagggtacgaaagtacgaaaacgtaaacgtggttacgggttcttacggcctaacctaagttccgtcgttacctttcgaacgtttcccg

SEQ ID NO: 346339 - DNA, 620 bp, Homo sapiens
  misc_feature: GZ8MTXP01D5Z59.21.65.F10.1.454.CMB.2.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccacctctcctgcagggccagtcagagtgttagcagcaacttagcctggtaccagcagaaacctggccagcctccaggctccncatctatggtncatcccgcagggccacgtggaactcccagcctaggttccagtggcacgtgggtctaggggacaaggagttcactctaccactatcagctagcctggcctagtcgtagtaaagttagtttttagaaacgtttttatttcgtcggtttcttacggtactaaggttaaaccaaagttccgaagggttcgggtaaccccgtttcggggtaaccggtttcgggaacccgtaaagggggaaacccgtaaaggggttagaaaacgttacgaaaacggtaacgttagggttcggcgtaagaccaacctacttcttacggttccgttaacttaaccg

SEQ ID NO: 346340 - DNA, 595 bp, Homo sapiens
  misc_feature: GZ8MTXP01EBSDV.21.65.F10.1.454.CMB.2.raw
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcagggccagtcagagtgttagcagcaacttagcctggtaccagcaagaaacctggccagccctccgaggcctcctcatctagtggtcncactccgcgagggccacgtggaactcccagccgtaggttcaggtggcacgtgggtctaagggacnggtacgttcacttctacaccatcagcagcctgctaggttactagtaaagttattttagaattttattctgttctaggactaagtacaagtccgaaggttcggtaccgttcgggtacggttccggaaccggtaaggggaaaccgtaaggggttaaggaaaacttaacgaaaacggtaacgttgggttcggacctaaggaccctaactcgtacttcgttccttctaaccg

SEQ ID NO: 346341 - DNA, 711 bp, Homo sapiens
  misc_feature: GZ8MTXP01DY2R5.21.65.F10.1.454.CMB.2.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaagctctggagaaatagtgatgacgcagtctccagccacctgtctgtgtctccgagggganagagcccaccctctcctgcagggccagtcagagtgttagcagctaacttgcctggaccagcagaacctggccagccctccagcctccnatctagtggtcncacgtcccgcgacgggccacgtggaacctcccgagccgtaggttcaggtcggactacggttcggggtacgtaaggggaacctaagggtacgttttaccaaccttccctaccaaccctatcccaacgggccacggtccccttagggacctaagggtttaccttaagggtaaacgtttacgttttttaaagggtaaagtttttttaactttcggttcggtttaccgttaggggtaaccttaaacggttaaaccctaaagttcccgtaagggtttcccgggtacccgtttaccgggggtaaccggttacccgggaacccgggtaaacggggtaaaccgtaaaggggttaacggaaaacgttaccgaaaaccggtacgttagggcgttcgtaacgacaacttatcgttcgtcttcgtaacc

SEQ ID NO: 346342 - DNA, 604 bp, Homo sapiens
  misc_feature: GZ8MTXP01AF6TL.21.65.F10.1.454.CMB.2.raw
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagagcccaccctctcctgcagggccagtcagagtgtagcagcaacttagcctggtaccagcaagaacctggccagcctcccaggcctcctcatctatggncatcccgcgagggccagtggaactcccagccaggttcagtcggcagtgggtcngggaacaggcttcactctcacatcagccagcctgctagtctagtaagttattttagaaagttttctttcgtgttcctagggactaaggttaacaagtcgtaggttcggcccgttacggggtaccgttccggggaacccgtaaagggggtaaccctaaaggggttaacggaaaacttaccgaaaaaccggtacgttgggttcgggccttacggaaccacctaacgttcttacggttcctttaacgaacgtttccccg

SEQ ID NO: 346343 - DNA, 537 bp, Homo sapiens
  misc_feature: GZ8MTXP01C91VV.21.65.F10.1.454.CMB.2.raw
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggaccagcagaacctggccagcctccagctcctcatctatgtncatccgcagggccacgtgactccagccaggttcacgtggcacgtgggtctagggacnggtacgttccacttctaccacatcagcacgcctgcagtctagtaagtattttagaagttttatttctgttctgactagtacaatcagttcggcctcggtacgttcggaccgtaaagggaaccgaagggttaggaaattacgaaaacggtacttaggcggactaaggcaacctatcttcgttcttctaac

SEQ ID NO: 346344 - DNA, 712 bp, Homo sapiens
  misc_feature: GZ8MTXP01CVXD5.21.65.F10.1.454.CMB.2.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaagctctggagaaatagtgatgacgcagtctccagccaccctgtctgtgtctccgagggganagacgcccaccctctcctgcagggccagtcagagtgtagcagcaacttagcctggaccagacaagaacctggccacgccctccgaggcctccncatctagtggtcncacgtcccgacgacgggccacgtaggaacctcccgagtccgtaggttccgaggttcggactacggttcggggtccgtaaggggaacctaaggtaccgtttacccaaccttccaccgaaccctagtaccaggtccacggtccgtggacgttaacgttcgttaagttaagtttagttttagttaaacgttttttctttcgttacgttacggttacgtaacgttaacgttaacgtaacgttccggtacgggttccggtacccgttacgggtaccggttaccgggaaaccggtaaacggggtaacgtaaagggttaacggtaaaaccgttaaccgtaaaacggtacgttacgggttcgttacccgtaacgtaccctaacgttacttccgttacgtttcccgtttaaccgtaacccg

SEQ ID NO: 346345 - DNA, 544 bp, Homo sapiens
  misc_feature: GZ8MTXP01EW5P3.21.65.F10.1.454.CMB.2.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (527)..(527): a, c, t, g, unknown or other
  misc_feature (527)..(527): n is a, c, g, or t
  modified_base (539)..(539): a, c, t, g, unknown or other
  misc_feature (539)..(539): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtagcagcaacttagcctggtaccagcaagaaacctggccagccctccaggctcctcatctatggtncactccgcagggccacgtggaactcccgagcctaggttcaggtcggcagtgggtctaggggacngtattcacttcacaccatcagcagcctagctagtctagtaagttnttttaggaattttntttcgtgttctgtactaagttacaatcgagttcggaccgtcggtacgttcggacgtaagggaacctaagggttagaaacttcgaaacgtacttggttcgctgcaacgntcgttgtccttntaacc

SEQ ID NO: 346346 - DNA, 518 bp, Homo sapiens
  misc_feature: GZ8MTXP01AV01Y.21.65.F10.1.454.CMB.2.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (389)..(389): a, c, t, g, unknown or other
  misc_feature (389)..(389): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggaccagcagaacctggccagcctccagctccncatctatggtncatccgcagggcccagtggaactcccagccaggttcagtggcagtgggtctagggacngtagttcactctcacatcagcagcctgcagtctagaatnttttaggaattttattctgtctagctagtacaatcgagtggcctcggtacgttcggaccgaagggaaccaagggttggaaattcgaaacgtacttggttggcctgccaactagtcttgtccttcgtaac

SEQ ID NO: 346347 - DNA, 551 bp, Homo sapiens
  misc_feature: GZ8MTXP01ADBBH.21.65.F10.1.454.CMB.2.raw
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
tcagtcgtcgctcgcacgaccggtgctcgatttagctacgctctaagggggaggaactgctcagttaggacccatacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctcatctatggtncatccgccgagggcccagtggaactcccagccaggttcagtggcacgtgggtctaggggacnggtacgttcacttcctacaccatcagcacgcctgcagtctgtaagttattttgaagttttattcgtgtcgtgtctagtacaatcgagtcggcctgggtcgttacggaccgaaggggaaccgaaagggttaggaaacttcgaaaacggtaacgttggttcggctcggcaaccgtactcttcgtaaccttcgtaacc

SEQ ID NO: 346348 - DNA, 524 bp, Homo sapiens
  misc_feature: GZ8MTXP01EA3PE.21.65.F10.1.454.CMB.2.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (409)..(409): a, c, t, g, unknown or other
  misc_feature (409)..(409): n is a, c, g, or t
  modified_base (507)..(507): a, c, t, g, unknown or other
  misc_feature (507)..(507): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccacctctcctgcagggccagtcagagtgttagcagcaacttagccttggtaccagcagaaacctggccagcctccaggctcctnatctatggtncacgtccgcagggccacgtggaactccgagccaggttcacgtggcacgtgggtctgggacngtattcactctacacatcagcagcctgctagtctagtaagtatttgaaagtttnttcgtgttcgtgtactagtacagtcgagtcgcctcggtacgttcgccgaagggaacaaggttggaaattacgaaagtacttggttcgcgtgctaacgntcgttgtcgttctaacg

SEQ ID NO: 346349 - DNA, 530 bp, Homo sapiens
  misc_feature: GZ8MTXP01CR775.21.65.F10.1.454.CMB.2.raw
  modified_base (351)..(351): a, c, t, g, unknown or other
  misc_feature (351)..(351): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaagctctggagaaatagtgatgacgcagtctccagccaccctgtctgtgtctccgaggggagagagcccaccctctcctgcagggccagtcagagtgtagcagcaattagcctgtaccagcagaactggccagcctccaggctcctcatctatggtgcatcccgcagggccactggaactcccagccaggttcagtggacacgtgggtctaggggacnggacgtcactctacaccatcagcagcctgcagtctagaagttattttagaagtttatttcgtgttctagctagtacaatcgagtcgaccgtggtaccgttcggaccgaagggaaccaagggttaggaaacttcgaaaacgcttaggttggacctgactaaccattcgttntccttntcc

SEQ ID NO: 346350 - DNA, 538 bp, Homo sapiens
  misc_feature: GZ8MTXP01E2MQ2.21.65.F10.1.454.CMB.2.raw
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcaagaaacctggccacgccctcccagcctcctcatctatggtgcatcccgccgacgggccactggaactcccagccaggttcagtggcacgtgggtcgtagggacngtagtcactctcacatcagcagcctgcagtctagtaatatttagaagtttnttctgtctgctagtacaatcgagtcgccgtcggtacgttcggacgaagggaaccgaaaggttaggaaacttacgaaaacgtacttggttcggctggctaaccacttcttacgttcttcgtaacc

SEQ ID NO: 346351 - DNA, 614 bp, Homo sapiens
  misc_feature: GZ8MTXP01DQTFY.21.65.F10.1.454.CMB.2.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggganagagcccaccctctcctgcagggccagtcagagtgttagcagcaacttagcctggtaccagcaagaaacctggccagccctcccaggcctcctcatctatggtncactcccgcagggccactggaactcccagccagttcagtcggctacgtgggtctaggggacnggagtttccaacttctaccaccatcagcacgcctgctagtactagtaagttattttagaaagttttatttcgttgttacgttcggtactaagttaaccaagttccgtaggttcggtacccgttccgggtaaccgggtttccggacccggaaaggggtaacccgtaaagggttacgggaaaacttaccgaaaaacggtaccgttaggttcggttactcggaccaaccgtacttcgttcgttcctttcgtaaccg

SEQ ID NO: 346352 - DNA, 595 bp, Homo sapiens
  misc_feature: GZ8MTXP01DJHW5.21.65.F10.1.454.CMB.2.raw
  modified_base (194)..(194): a, c, t, g, unknown or other
  misc_feature (194)..(194): n is a, c, g, or t
  modified_base (464)..(464): a, c, t, g, unknown or other
  misc_feature (464)..(464): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagagcccaccctctcctgcagggccagtcagagtgtagcagcaacttagcctggaccagcaagaaacctggaccacgccctcccgaggcctcctcattctagtggtcgcacgtcccgaccgacggggcccaacgtcggaaacctccccgaagccctaggtttccaggtcggactacggtcggggtctaaggggacaaggtacgtttccaaccttctaccacctatcagccacgccctgcctagtactagaagttagttttagaaattttnttctagtctgactaagtacaagtcaggtcgaccgtcggtacgttcggacaagggaacgtaaggttaggaaacttacgaaaacggtacttgggcgcgtaacgcaacctagttccttacgttccttcgtaacc

SEQ ID NO: 346353 - DNA, 563 bp, Homo sapiens
  misc_feature: GZ8MTXP01AYNIM.21.65.F10.1.454.CMB.2.raw
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagacgcccaccctctcctgcagggccagtcagagtgttagcagcaacttagcctggtaccagcagaaacctggccagcctcccgaggcctcctcatctatggtgccatcccgccgagggcccacgtgggaactcccgagccaggttcagtcggctacgtgggtctggggaacaggtgttcacttctcaccatcagcagcctgcagtctagaagttnttttagaagtttnttctgtctggctagttacaagtcgagtcgccgtcggtacgttcggaccgtaaagggaccgaaaggtagaaactaccgaaacgtaacgtggttcggcttaggaaccactaattcgttgttacttaacgttcccgttcccg

SEQ ID NO: 346354 - DNA, 524 bp, Homo sapiens
  misc_feature: GZ8MTXP01DITEL.21.65.F10.1.454.CMB.2.raw
  modified_base (349)..(349): a, c, t, g, unknown or other
  misc_feature (349)..(349): n is a, c, g, or t
  modified_base (511)..(511): a, c, t, g, unknown or other
  misc_feature (511)..(511): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccaggggagagagccacctctcctgcagggccagtcagagtgttagcagcaacttagcctggtaccagcagaacctggccagcctccaggctcctcatcatggtgcatccgccagggccatggaactcccagccaggttcagtggcacgtggggtctaggggacnggagttcaactctcaccatcagcagcctgcagtctaggaagtatttgaagtttattctgttactgtacaagttaacaatcaaggtcgtacctggtaccgttcggcctaaaggggaaccaaaggttggaaattacgaaacgaacttagttggctgacaaccgntcttgtcttgaac

SEQ ID NO: 346355 - DNA, 611 bp, Homo sapiens
  misc_feature: GZ8MTXP01CZTO7.21.65.F10.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctcagccacctgtctgtgtctccgagggganagagccaccctctcctgcagggccagtcagagtgtagcagcaacttagcctggtaccagcaagaacctggccacgcctccaggctcctnatctatggtgcactccgcagggccagtggaactcccagcctaggttcagtcggcacgtggggtctaaggggacaaggtacgttcactctacaccatccagcaggccctggcaagttctaggaagttattttagaaagttttctttctagttctaggtactaagtaacaagttcgacggttcggcccgtacgggtacgttaccgggaccgaaaggggtaaccctaaagggggttacgaaaaagttccgaaaaacgggtaaccgttaggttcggggttaccttaaggtacccaacccgtattacccggttagttcccgtttcgtaacccg

SEQ ID NO: 346356 - DNA, 598 bp, Homo sapiens
  misc_feature: GZ8MTXP01BY132.21.65.F10.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcagaaacctggccagccctcccaggcctccncatctatggtcncactccgcacgggccacgtggaactcccagccaggttcaggtggcacgtgggtctaaggggacaaggtcgttcacttctaccacatcagcagcctgcctagtctagaagttagttttagaaagttttatttcgtagttcgtgtactaagttaacaagttcgaggttcggacccgttacgggtaaccggttccgggaaccgaaaggggtaacccgtaaagggttacggtaaaacttacgaaaaaccggtacgttcggttcggacgtgacctaaccgtacgtcttacgttcctttcgtaacc

SEQ ID NO: 346357 - DNA, 523 bp, Homo sapiens
  misc_feature: GZ8MTXP01BPCPT.21.65.F10.1.454.CMB.2.raw
  modified_base (293)..(293): a, c, t, g, unknown or other
  misc_feature (293)..(293): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
  modified_base (492)..(492): a, c, t, g, unknown or other
  misc_feature (492)..(492): n is a, c, g, or t
tcagtcgtcgctcgcacgaccggtgctcgatttagctacgctctaagggggaggaactgctcagttaggacccagacggaaccatggaagccccagtgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctccaggctcctcatctatggtncatccgccagggccacgtggaactcccagccaggttcacggtggcacgtgggtctaggggacngagttcactctcaccatcagcagcctgctagtctagtaagtattttgaaagtttntttcgtgttcgtgactagtacaatcaggtggcctcggtcgttcggcgaagggaaccaagggttaggaaattcgaaacgtanggttcggctgcaacatcttgtccttgtaacc

SEQ ID NO: 346358 - DNA, 521 bp, Homo sapiens
  misc_feature: GZ8MTXP01AMUCV.21.65.F10.1.454.CMB.2.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaagctctggagaaatagtgatgacgcagtctccagccaccctgtctgtgtctccagggganagagccaccctctcctgcagggccagtcagagtgttagcagcaacttagcctggtaccagcagaacctggccagcctccaggctcctcatctatggtncactccgcagggccatggaactcccagccaggttcagtggcacgtggggctaggggacnggagttccactctcaccatccagcagcctgcagtctagaagttatttagaagttttattctgtctgctagtacaatcagtcggcctcggtacgttcgaccgaaggggaaccaagggttcggaaattcgaaacgtacttggttgactgacaaccgatcttgtcctttcaacg

SEQ ID NO: 346359 - DNA, 627 bp, Homo sapiens
  misc_feature: GZ8MTXP01EIF09.21.65.F10.1.454.CMB.2.raw
  modified_base (196)..(196): a, c, t, g, unknown or other
  misc_feature (196)..(196): n is a, c, g, or t
  modified_base (314)..(314): a, c, t, g, unknown or other
  misc_feature (314)..(314): n is a, c, g, or t
  modified_base (458)..(458): a, c, t, g, unknown or other
  misc_feature (458)..(458): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccacctgtctgtgtctccgagggganagacgcccacctctcctgcgagggccagtcagtagttgtagcagctaacttcgccttaggaccagacaacgaaacctggaccacggccctaccgagcctcctacattctagtcggtcnctacgtcccgacgacgggccacgtaggaacctccacgtcgtaggttcaggtcggactaggtgggctaaggggactggtacttccactcctacacatcgagcagccgtgacctagttcgtagttaagttgtttaggtaatttttnttcgtcgttacgtagtaacgtaatacgtagtcgtaggttccggtaccggttacggtaccggtacggaaccggaaacgggtaaacggtaaggttaacggtaaacttaacggaaacgtcggttaggttcgacgtaacgaccgtaacttcgtcgttacttccgttaacgtcc

SEQ ID NO: 346360 - DNA, 567 bp, Homo sapiens
  misc_feature: GZ8MTXP01BF6S1.21.65.F10.1.454.CMB.2.raw
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgttagcagcaacttagcctggtaccagcagaaacctggccagccctccaggctcctcatctatggtncatcccgcagggccactggaactcccagccaggttcagtggcacgtgggtctaggggacnggagttccactcncaccatcagcagcctgcagtctagaagtnttttagaagttttattcttgttcgtgtctagtactatcgaggttgcccgttcggtacgttccgggaccgtaaaggggaaccgtaagggttagggaaacttacgaaaacggtaacgttgggttcgggttaccttcggaccaacctaacgtcttacggttcctttctaaccg

SEQ ID NO: 346361 - DNA, 526 bp, Homo sapiens
  misc_feature: GZ8MTXP01D9STB.21.65.F10.1.454.CMB.2.raw
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccacctctcctgcagggccagtcagagtgtagcagcaacttagcctggtaccagcagaaacctggccagccctccaggctcctcatctatggtncactccgcagggccacgtggaactcccgagccaggttcaggtcggcacgtggggtctaggggacnggtacgttcactctcaccatcagcagcctgcagtctagtaagtnttttagaagtttattctgttctgtctaagtacaatcgagtcggcctcgggcgttcggccgaagggaaccaagggttagaaattcgaaacgtacttgttcgttctgacncatcttntcttgtaacc

SEQ ID NO: 346362 - DNA, 554 bp, Homo sapiens
  misc_feature: GZ8MTXP01BOWN9.21.65.F10.1.454.CMB.2.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgtancagcaattgcctgtaccagcagaaacctggccagccctcccaggctcctnatctatggtncatccgcagggccactggaactcccgagccaggttcaggtgcacgtgggtctgggacngacgttcactctacacatcagcacgctgcagtctagaagttattttagaagtttnttctgtcgtgactagtactaagtcgagttcgccgtcggtacgttcggaccgtaaacggggaacgaaagggttacggaaaagttaccgaaaacggtacttacgggttcggactcggacctaacgtaattcgttcgttctttcccgtaac

SEQ ID NO: 346363 - DNA, 648 bp, Homo sapiens
  misc_feature: GZ8MTXP01ET2LD.21.65.F10.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (384)..(384): a, c, t, g, unknown or other
  misc_feature (384)..(384): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcgagggccagtcagagtgtagcagctaacttagcctggtaccagcaacgaaccgtggccacgccctaccgaggtcctcctnattctagtggtcncacgtccgacgacgggccacgtacggaacctccgacgccgtaggtcaggtcggactacggtgggtcgtaagggacnggtcttaccactctacacatcacgtcacgtctagctagttagtagttaagtttattttaggtaaactttttcgttacgttcgttaccggtaggtaaccttaaacgtaacgtaacgtcggtaacgggttccgtacccggttacgggtaccggttaccggaaccgggaaaggtaaacccgtaagggttaacgaaacgttacgaaaccggtaagttcggttcggaccttcgactaacccttgttcttacctttccttcgtaaccccg

SEQ ID NO: 346364 - DNA, 556 bp, Homo sapiens
  misc_feature: GZ8MTXP01DT7P0.21.65.F10.1.454.CMB.2.raw
  modified_base (301)..(301): a, c, t, g, unknown or other
  misc_feature (301)..(301): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagacgcccaccctctcctgcagggccagtcagagtgttagcagcaacttagcctggtaccagcaagaaacctggaccagcctcccgaggcctcctcatctatggtncactccgcagggccagtgaactccagccaggttcagtcgcagtgggtctgggaacagtcgttcacgtctacaccatcgagcagcctgctagtctagtaagttattttaggaatttattctagttctgggactagttaacaagtcgagtcggcctacgggacttcggacgaaacgggtaccgaaaggtacgggaaataccgaaacgtaacgtgttaccggcttacgaactactgtctcgttaccttcgttcgtccg

SEQ ID NO: 346365 - DNA, 719 bp, Homo sapiens
  misc_feature: GZ8MTXP01DR6R0.21.65.F10.1.454.CMB.2.raw
  modified_base (299)..(299): a, c, t, g, unknown or other
  misc_feature (299)..(299): n is a, c, g, or t
  modified_base (497)..(497): a, c, t, g, unknown or other
  misc_feature (497)..(497): n is a, c, g, or t
tcagtcgtcgctcgcacgaccggtgctcgatttagctacgctctaagggggagggaactgctcagttaggacccagacggaaccatggaagccccagcgcagcttctcttcctcctgctactctggctcccagaaagctctggagaaatagtgatgacgcagtctccagccacctgtctgtgtctccgaggggagagagccacctctcctggcgagggccagtcagagtgtagcagcaacttagcctggtaccagcaagaaacctggaccagccctccaggcctcctcatctatgggtncacgtcccgacgacgggcccagtaggaactcccgagcccgtaagggttccaaggtcggactaacggttcggggtaccgtaaggggaacctaagggtacgtttacccgaaccttccgtacccgaaacccagttaccgaacgtccgaaacggtccccttagggcctaaacgggttacccgttaaggtaaaaacgggtttntttttttaaccggaaaacggtttttttatttaccgttacggtttaccctaggtaacccgtaaagtttaaacggaaacttcccggaaggtttcgggaccccgttacggggtaacccgtttacgggaccgtaaacgggggaaccctaaagggaccggtaaaattaccggaaaacgtcttaggttcggacttcggactccgtactcgttcgtcttccggtaaccg

SEQ ID NO: 346366 - DNA, 590 bp, Homo sapiens
  misc_feature: GZ8MTXP01EXSQH.21.65.F10.1.454.CMB.2.raw
  modified_base (570)..(570): a, c, t, g, unknown or other
  misc_feature (570)..(570): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggcctcccagaaagctctggagaaatagtgatgacgcagtctccagccaccctgtctgtgtctccgaggggagagacgcccaccctctcctgcagggccagtcagtagtgttagcagctaacttgcctaggtaccagcaagaaacctggccacgccctccgagtcctcctcatctagtggtcacacgtcccgacgacgggcccacgtacggaactcccgagccgtaggttccaggtcggactaggttcggggtccgtaaggggactaagggtacgttccacttcctacacctatccagtccacgcctagcagttactagtaagttattttagaatttgttctgtactgactaagtacatcgagtcgtccgtcggtacgtcggacgtaaaggggaactaagggttagaaacttcgaaaacgtacgttggcgttacgtcgactaactnttacgttgtccttaactccg

SEQ ID NO: 346367 - DNA, 586 bp, Homo sapiens
  misc_feature: GZ8MTXP01CS1TN.21.65.F10.1.454.CMB.2.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgtagcagcaacttgcctggaccagcaagaacctggccagccctccagcctcctcatctagtggtcncacgtcccgcgaggggcccacgtcggaactccccgagccgtaggttccaggtcggctacgtggggtctaggggacngtacgttccacttcncaccatcagcagcctgcagtctagtaagttattttagaaagtttttnttcgtgttctagtactagtaactagtcgaggtcggtaccgtacgggtacgttcgggaaccgtaaacggggaaccgtaagggttaacgtaaacttaacggaaacggtacgttggttcggactcgaccaacgtcttcgttacgttccttcgtaacc

SEQ ID NO: 346368 - DNA, 590 bp, Homo sapiens
  misc_feature: GZ8MTXP01ECFWR.21.65.F10.1.454.CMB.2.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggganagacgcccaccctctcctgcagggccagtcagagtgtagcagcaacttgcctggtaccagcaagaaacctggcccagccctcccaggcctcctcatctagtggtncactccgcgacgggccacgtggaactcccgagccgaggttcaggtcggctagtgggtctaggggacnggtattccactctcacatccagcagcctgctagtctagaaagttattttagaaagttttnttcgtgttacgtgactaagttacaatcgaggtcggtaccgttcggacgtttaccggaccgaaggggaaccgtaaagggttacgggtaaaacttaacgaaaaccggtaacgttggttcgggttactaagacctaaccctattcgttcgttcctttcgtaacc

SEQ ID NO: 346369 - DNA, 541 bp, Homo sapiens
  misc_feature: GZ8MTXP01CVD2L.21.65.F10.1.454.CMB.2.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (380)..(380): a, c, t, g, unknown or other
  misc_feature (380)..(380): n is a, c, g, or t
  modified_base (425)..(425): a, c, t, g, unknown or other
  misc_feature (425)..(425): n is a, c, g, or t
  modified_base (522)..(522): a, c, t, g, unknown or other
  misc_feature (522)..(522): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctccaagaaagctctggagaaatagtgatgacgcagtctccagccaccctgtctgtgtctccgagggganagacgccaccctctcctgcagggccagtcagagtgttagcagcaacttagcctggtaccagcaagaaacctggccagcctcccaggcctcctcatctagtggtncactcccggccaagggcccacgtggaactcccgagccctaggttcaggtcggcagtgggtctgggaacagtcgttcactcncaccatcagcagcctgcagtctagtaagttattttagaaagtttnttcgtagtctggactagtacaatcgagtcgctacggcgtcggacgaagggacaaggtagaaatacgaaacgtacgtgttacggcttgaacctacgtntctgttcttcaacgttccc

SEQ ID NO: 346370 - DNA, 622 bp, Homo sapiens
  misc_feature: GZ8MTXP01C5XWM.21.65.F10.1.454.CMB.2.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctaggtaccagcagaaacctggccagcctccaggcctcctnatctatggtcncacgtcccgcgagggccacgtggaactcccagccaggttcaggtcggcagtggggtctaggggaacnggtagttccacttctaccaacctatcagcagccctgacctagtctagtaagttattttagtaagttttattcttggttcttacggacttaaagtaacctaagttcgtaacggttcggtacccgttcgggtaaccggtttccgggaaccgtaaagggggaaacccgtaaaggggttaacggtaaaacttaccggtaaaaacggtacgttaggttcgggactaacggaccaacctagtcttacgttccttcgttaaccc

SEQ ID NO: 346371 - DNA, 571 bp, Homo sapiens
  misc_feature: GZ8MTXP01ERPKJ.21.65.F10.1.454.CMB.2.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtaccagcaagaaacctggccagcctccaggctcctcatctatggtncactccgccagggccacgtggaactcccgagccaggttcaggtcggactacggtgggtcgtaggggacaaggtacgttccacttctacaaccatcagcagcctgcagttctagtaagtattttagaaagttttnttcgtgttcgtgtactaagtaactagtcgtaggtcggtaccgtcggtacgtaccggaccgaaacgggaacgtaaagggttagtaaacttacgaaaacgtacgttggttcgactgaccaactattcttcgttccttcgtaac

SEQ ID NO: 346372 - DNA, 497 bp, Homo sapiens
  misc_feature: GZ8MTXP01BI4F9.21.65.F10.1.454.CMB.2.raw
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccacctctcctgcagggccagtcagagtgttagcagcaacttagcctggtaccagcagaacctggccagcctccaggcctcctcatctatggtncatccgccagggccactggaactcccagccaggttcagtggcacgtggggtctggggacnggtagttcactctcaccatcagcagcctgcagtctagaagtatttgaatttattntgtctgctagtacaatcagtgcctggtcgtgccaagggaacaaggttggaaattcgaaacgacttggngntgcaacntcngtcttntaac

SEQ ID NO: 346373 - DNA, 519 bp, Homo sapiens
  misc_feature: GZ8MTXP01EZEHW.21.65.F10.1.454.CMB.2.raw
  modified_base (350)..(350): a, c, t, g, unknown or other
  misc_feature (350)..(350): n is a, c, g, or t
tcagtcgtcgctcgcacgaccggtgctcgatttagctacgctctaagggggaggaactgctcagttaggacccagacggaaccatggaagccccagcgcagcttctattcctcctgctactctggctcccagaaagctctggagaaatagtgatgacgcagtctccagccaccctgtctgtgtctccaggggagagagcccaccctctcctgcagggccagtcagagtgttagcagcaacttgcctggaccagcagaaacctggccagcctcccaggctcctcatctatggtgcatccgcacgggccatggaatccccagccaggttcagtggcacgtggggctgggacngagttcactctcaccatcagcagcctgcagttcagtaagtattttagaagtttattctgtctgcagtacaatcagtcgcctggtacgttcggccaaggggaacctaagggttacggaaattccgaaaacgtaacgttgttcggactgctaaccatcttgttcttctaac

SEQ ID NO: 346374 - DNA, 737 bp, Homo sapiens
  misc_feature: GZ8MTXP01BKAHX.21.65.F10.1.454.CMB.2.raw
  modified_base (196)..(196): a, c, t, g, unknown or other
  misc_feature (196)..(196): n is a, c, g, or t
  modified_base (317)..(317): a, c, t, g, unknown or other
  misc_feature (317)..(317): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccacctctcctgcagggccagtcagagtgttagcagctaacttagcctagggtaccagacaacgaaacctcgggacccacgcccctacccgaggtcctcctcatctagtcggtcncacgtcccgcgacgggccacgtggaacctcccgagccgtaggttcacggtcggactacggtcggggtacgtaacggggaacctaaggtacgtttcccacccgttcctacccaaccctagtacccgaacggtcccaacggtcccgttaggaccctaagggtttaccttaagggttaaagttttacgtttttaaggtaaacgttttttactttcgtttacgtttacctttaacgtaaacggtttaaactaaacgttccggtaacggttcccgggtaccgttaccggggtaaccggtttaccggggaaaccgtaaacgggggtaacctaaaaggggttacggaaaacttacccgaaaaggtacgttgggttcggacttacggaacctacgtaacttcgtcgttaccttccgttaacttccccg

SEQ ID NO: 346375 - DNA, 738 bp, Homo sapiens
  misc_feature: GZ8MTXP01CIG0W.21.65.F10.1.454.CMB.2.raw
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtagcagcaacttagcctggtaccagcaagaaacctggccacgccctcccaggcctcctcatctatggtcncactccgccagggccacgtggaactcccgagcccgaggttcacggtggctacgtgggtcgtaggggacaaggtacgtttccacttcctaccaaccctagtacccaagtccaacggccctggaccctaggttaccgttaggtaaagtttattttttacgggtaaaacgttttttattttcccgttggtttaccgttacgggtaccttaaacggttaaccctaaagtttccgaaacgggtttcgggtacccccggtttacggggtaaccgggttttcccggggaaaccccgtaaaacggggggtaaaccccgtaaaagggggtttaacgggaaaaacgttacccgtaaaaaaccgggtacggttacgggttgggttaaccttcggaaacccgtaaccccgttaagtcccctttaggttaaccccgtttccgttaaccccg

SEQ ID NO: 346376 - DNA, 554 bp, Homo sapiens
  misc_feature: GZ8MTXP01C62CD.21.65.F10.1.454.CMB.2.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
  modified_base (423)..(423): a, c, t, g, unknown or other
  misc_feature (423)..(423): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaagctctggagaaatagtgatgacgcagtctccagccaccctgtctgtgtctccgaggggagagagcccaccctctcctgcagggccagtcagagtgtagcagcaacttagcctaggaccagcagaaacctggccagccctccagctcctnatctatggtncactcccgacgagggcccacgtggaactcccagccgaggttcaggtggcacgtggggtctaaggggacnggtagttccacttccncaaccatccagcagcctgcagtctagaattattttagaaatttnttctgtctgctagtacaatcgagtcgcctcggtacgttcggaccgtaaagggaaccgaagggttagggaaaacttacggtaaaacgacgttggcggttactcggacaacctagtcttacgtcttcgtaacc

SEQ ID NO: 346377 - DNA, 583 bp, Homo sapiens
  misc_feature: GZ8MTXP01DBWQ7.21.65.F10.1.454.CMB.2.raw
  modified_base (263)..(263): a, c, t, g, unknown or other
  misc_feature (263)..(263): n is a, c, g, or t
  modified_base (425)..(425): a, c, t, g, unknown or other
  misc_feature (425)..(425): n is a, c, g, or t
  modified_base (559)..(559): a, c, t, g, unknown or other
  misc_feature (559)..(559): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctcgaggggagagagccacctctcctgcgagggccagtcagagtgtagcagcaacttagcctggtaccagcaagaaaccnggaccacgccctccgagcctcctcatctagtggtcgcacgtcccgaccgacgggccctacgtaggaactccccgagtcccgaggttccaggttcggactacggtcgggtcgtacggggaacaaggtacgttccacttcctaccacatcgacgcgacgtccgngacctagtcgtagtaagtttagtttagtaaagttttcttctgttcgtgactaagtactaagtcgagtcgaccgtcggtacgttcgacgaagggaacaagggttagaaacttcgtaaacgcttaggcgactgacncgtatcgttcgttcttcgtaaccg

SEQ ID NO: 346378 - DNA, 586 bp, Homo sapiens
  misc_feature: GZ8MTXP01EDVTQ.21.65.F10.1.454.CMB.2.raw
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
  modified_base (425)..(425): a, c, t, g, unknown or other
  misc_feature (425)..(425): n is a, c, g, or t
  modified_base (561)..(561): a, c, t, g, unknown or other
  misc_feature (561)..(561): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggaccagcaagaaacctggccagcctccaggctcctcatctatggtncactccgcagggccacgtggaactcccagccaggttcaggtggctacgtgggtctagggaacnggtacttccactctacaccatccagcacgcctagctagtctagtaaagtnttttagaaagtttttnttcgtgtacgtgtactagtaactaagtcgagtcggtaccgtacgggtaccggttacggaaccggaaacggggtaaccgtaaagggttaacgaaacttaacgtaaacgtacgttggttcgacgtcgacctaaccgtnttcgttacgttccttaacgtaaccg

SEQ ID NO: 346379 - DNA, 521 bp, Homo sapiens
  misc_feature: GZ8MTXP01DFD3N.21.65.F10.1.454.CMB.2.raw
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
  modified_base (515)..(515): a, c, t, g, unknown or other
  misc_feature (515)..(515): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaacctggccagccctccaggcctcctcatctatggtncatccgcagggccacgtggaactcccagccaggttcagtggcacgtgggtctagggacnggagttcactctcacatcagcagcctgcagtctagtaatatttgaattttattctagttcttacaagttacaatcgagtcggccttacgggacgttcggaccgtaagggaacctaagggtagaaatacaaagaacgtgcggnttgcactntctgttctcnctcccg

SEQ ID NO: 346380 - DNA, 602 bp, Homo sapiens
  misc_feature: GZ8MTXP01AUJHX.21.65.F10.1.454.CMB.2.raw
  modified_base (195)..(195): a, c, t, g, unknown or other
  misc_feature (195)..(195): n is a, c, g, or t
  modified_base (368)..(368): a, c, t, g, unknown or other
  misc_feature (368)..(368): n is a, c, g, or t
  modified_base (435)..(435): a, c, t, g, unknown or other
  misc_feature (435)..(435): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctaggtaccagcagaaacctggccagccctccaggcctctcatctagtggtgcatcccgcgacgggccacgtggaactccccagccctaggttcaggtcggctacgtggggtctaggggacnggtacgttccactctacaccatcagcacgcctgctagtacgtagtaagttattttagtaaagttttnttcgtggtcttggctaagtaacctaagttccgaggttcggtacccgttccggggtaccggttccgggaaccgaaacggggaacccgtaaagggttacgggaaaacttaccgaaaacgggtacttcggagggttccctgacctaaccgattcgttctcgttaacgtcc

SEQ ID NO: 346381 - DNA, 603 bp, Homo sapiens
  misc_feature: GZ8MTXP01B4DBX.21.65.F10.1.454.CMB.2.raw
  modified_base (371)..(371): a, c, t, g, unknown or other
  misc_feature (371)..(371): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggaccagcaagaacctggccagccctcccaggcctcctcatctatggtgcactccccgcaggggcccacgtggaactccccgagccaggttccaggtcggcacgtggggtctaggggacaaggngttccactctccacatccagcacgcctgctagtacgtagtaaagttattttagaagtttttatttcttgttctgctaagtacaatcgtaggtcggtcccgttcgggtccgttaccgggaccggaaacggggtaaccgtaaaggggttagggaaaaccttacgaaaaccggtacgttaggttacgggccgttaaggaccctaacccgtagttccttacgtttccttcgtaacc

SEQ ID NO: 346382 - DNA, 682 bp, Homo sapiens
  misc_feature: GZ8MTXP01DIOAO.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagccctaggtaccagcagaaacctggccagccctccagctcctcatctatggtgcatcccgcacgggccacgtggaactccccagccaggttccagtcggactacgtggggtctagggggactaaggtacgtttccaacttccgtaccaccctatccgaacgcaacgtccctgcctaagtcttaggtaaagttagttttggtaaacgtttttacttttcgttcggtttcttacggtacgtaaacgttaaccgtaaattccgtaacgggttcggtacccgtttaccgggggtaacccggtttaccggggaacccggtaaagggggtaaacccgtaaagggggttagggtaaaaacttaccggtaaaaaaccggtacgttaacggggttcggaccgttcggaccaacccgtagttccttcggtttccctttaacgtaacccg

SEQ ID NO: 346383 - DNA, 639 bp, Homo sapiens
  misc_feature: GZ8MTXP01DIN7Z.21.65.F10.1.454.CMB.2.raw
  modified_base (287)..(287): a, c, t, g, unknown or other
  misc_feature (287)..(287): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (613)..(613): a, c, t, g, unknown or other
  misc_feature (613)..(613): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcaggagtgttagcagcaacttagcctggaccagcagaaacctggccagccctccagcctcctnatctatggtgcactcccgcgagggccacgtcggaactcccgagccgtaggttcaggtcggactacgtggggtcgtaggggacnggtacgttccactctccaacntcagcacgcctgctagtctagtaagttattttaggtaagttttactttcgtcggttcgttacggtacctaaagttaactaagttccgtaggttccgggtacccgttaccgggggtaccggtttacccgggacccggaaaacgggggtaacccgaaagggggttacggaaaacttaccggtaaaacggtacgttagggttcgggacctcggaactaaccgttntaccgttgttcccgttcgtaaccccg

SEQ ID NO: 346384 - DNA, 607 bp, Homo sapiens
  misc_feature: GZ8MTXP01ECEG3.21.65.F10.1.454.CMB.2.raw
  modified_base (295)..(295): a, c, t, g, unknown or other
  misc_feature (295)..(295): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagagccaccctctcctgcagggccagtcagagtgtagcagcaacttagcctggtaccagcaagaaacctggccagcctcccaggctcctcatctatggtncacgtcccgccgaggggcccacgtgggaaactccccgagcccaggttcaggtcggcagtggggtctggggaacagcgttcactctcaccatcagcagcctgcagtctagaagttattttagtaagtttatttcgtagttcctagggtactaaggttaaccaagttcgtaggttcggcccgttacggggtaccgttccggggaccctaaacgggggacctaaagggtacgggaaaactacgaaaaccggtaagtcgggttagggccttacggccaacccgtaagttccctgttactttcccgaagtttccccg

SEQ ID NO: 346385 - DNA, 692 bp, Homo sapiens
  misc_feature: GZ8MTXP01B0S5G.21.65.F10.1.454.CMB.2.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
tcagtcgtcgctcgcacgaccggtgctcgatttagctacgctctaagggggaggaactgctcagttaggacccagacggaaccatggaagccccagcgcagcttctcttccttctgctactctggctcccagaaagctctggagaaatagtgatgacgcagtctccagccaccctgtctgtgtctccagggganagagccacctctcctgcagggccagtcagagtgttagcagcaactagcctggaccagcaagaacctggaccacgccctccaggcctcctcatctatggtcncactcccgacgacgggccacgtggaacctcccagcctaggttccaggtcggactacggtcggggtctaggggaacctaaggtacgttccaacgttcctaccaaccatccaagcacgccgtgcctagttccgtaagtaagtttagttttagtaaagttttctttacgttcggttacttacggtacttaaacgttaacctaacgttcgtaacgggtcggtaccccgttacggggtaacccggttacccggggaaacccggtaaacgggggaaacccgttaaagggggttaaaccggtaaaacttaaccggtaaaaccgtaaaccggttggttacgggaccgttcggaacccctaacccttagttcccgttacgggtttaaccctttaaccgttaacccg

SEQ ID NO: 346386 - DNA, 645 bp, Homo sapiens
  misc_feature: GZ8MTXP01DEZO9.21.65.F10.1.454.CMB.2.raw
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaagctctggagaaatagtgatgacgcagtctccagccaccctgtctgtgtctccgaggggagagagcccaccctctcctgcagggccagtcagagtgttagcagcaacttagccctggtaccagcagaaacctggccagcctccaggctcctcatctatgtncatccgcagggccacgtgaactcccagccaggttccagtcggactacgtggggtctaggggacnggtacgttcactctaccaccatcagcacgcgtgctagtacgtagtaagttagttttagttaaagttttagtttcgttagttcgttagtaccgtaaagttacctaaagttcgtacggttcgggtacccgttacggggtaaccggtttacccggggacccgggtaaaacggggtaacccgtaaaggggttaacggtaaaacgttaccgaaaaacggtacgttacgggttacggttaccgttaacgacccgtaacctacgttccgttacgttccgttaaccgttaacccg

SEQ ID NO: 346387 - DNA, 510 bp, Homo sapiens
  misc_feature: GZ8MTXP01DT8J6.21.65.F10.1.454.CMB.2.raw
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (482)..(482): a, c, t, g, unknown or other
  misc_feature (482)..(482): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggaccagcagaaacctggccagccctccagctcctcatctatggtncactccgcagggccacgtggaactcccagccaggttcagtggcagtgggtctgggacnggnttcactcncacatcagcagctgcagtctagaatatttagagtttattctgtctgactagtacaatcgagtgcctggtacgttcggacgtaagggaacaagggttagaaacttacgaaaacgtacgttgnggctgacaacctatccttagtcttctcg

SEQ ID NO: 346388 - DNA, 533 bp, Homo sapiens
  misc_feature: GZ8MTXP01A208W.21.65.F10.1.454.CMB.2.raw
  modified_base (295)..(295): a, c, t, g, unknown or other
  misc_feature (295)..(295): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaattagcctggaccagcagaacctggccagccctcccaggcctcctcatctatggtncactcccgccgagggccacgtggaactcccagccaggttcagtggcacgtgggtcngggacngtagtcactctcacatcagcagcctgcagtctagtaagttnttttaggaattttnttcgtgtctgctagtacaatcaggtcgccgtcggtcgttcggccgaagggaacctaagggttgaaacttcgaaaacggtacttggttcggctcggtcaacctatcgttagtcttcgtaacc

SEQ ID NO: 346389 - DNA, 574 bp, Homo sapiens
  misc_feature: GZ8MTXP01C5UXP.21.65.F10.1.454.CMB.2.raw
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggagagagccaccctctcctgcagggccagtcagagtgttagcagcaacttagcctgacngcagaactgcagcctccagctccncatctatggtcgcacgtcccgccgaagggccctacgtggaactcccgagcccaggttccaggtcggactagtcggggtctacggggaactggtacgttccaccttctccaacctatccagccaagtcctgactagtactaggtaaagttatttttaggtaattttatttccgtagttcctagtcctaagtacaatcaggtcgtccgtcggtacgttcgaccgaagggaaccaaggttaggtaaacacgaaacgtgttacggttcgactcgacctaactatcgttactccgttcgtaaccg

SEQ ID NO: 346390 - DNA, 614 bp, Homo sapiens
  misc_feature: GZ8MTXP01CBCV7.21.65.F10.1.454.CMB.2.raw
  modified_base (564)..(564): a, c, t, g, unknown or other
  misc_feature (564)..(564): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccgccctgtctgtgtctccgaggggagagacgccaccctctcctgcagggccagtcagagtgtagcagcaactagcctggtacagcagaacctgaccacgccccagcctcctcatctagtggtgccactcccgaccgacgggccctacgtcggaaactcccgagcctaggttcaggtccggctacggtgggtcgagggaactaggtcgttccacttccgtaccacctagtcacgtacacgtcctgacgtagtcgtaagtaagtttattttagtaagtttattcgtgtctggtactagtactaagtcgtacggtcggtccgtacggggtcgttaccggacggaacgggaaccgtaagggtaacgaaacgtaacgaaacggtaacgtggttacggttnttaccgaacctaaccgtgttacctcgttaccttccgttaacgtttccccg

SEQ ID NO: 346391 - DNA, 552 bp, Homo sapiens
  misc_feature: GZ8MTXP01BT0PC.21.65.F10.1.454.CMB.2.raw
  modified_base (196)..(196): a, c, t, g, unknown or other
  misc_feature (196)..(196): n is a, c, g, or t
  modified_base (369)..(369): a, c, t, g, unknown or other
  misc_feature (369)..(369): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcaagaaacctggccagccctcccgaggcctcctcatctagtggtgcacgtcccgcacggggcccacgtggaactcccgagcctaggttcagtcggcacgtgggtctagggacnggacgttcactcacaccatccagcagcctgcagtctagtaagttattttagaagttttattcgttgtcgttgtactagtaacatcgagtcggccgtcggtacgttcggaccgaaggggaaccaagggttcgaaattacgaaacgtaacttgggttcgctgacaactatcttacgttcttctcg

SEQ ID NO: 346392 - DNA, 736 bp, Homo sapiens
  misc_feature: GZ8MTXP01AEU3C.21.65.F10.1.454.CMB.2.raw
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcgagggccagtcagagttgtagcagcaacttagcctggaccagcaagaacctggccacgccctccgagcctccnctatctatggtcnccacgtcccgacgacgggccacgtaggaacctcccgagcccgtaggttccagtcggctacgtggggtctaacggggactaaggtacgttccacgtcctaccaactacgtaccgagtaccacggcccctaggccctaggtttaccgtaagtaaagttttacgtttttaaggtaaagttttttactttccgttagggtttcctacgggtaaccttaggtttaaacccaaaggttccggtaacgggttccggtaccccgggttacggggttaacccggtttacccggggaaaccggtaaacggggtaacccggtaaaggggttaaacggggaaaacttaacccgggaaaaaccggtaacggtttcggggttcgaaccgggttccgaaccgtaaccccgttaattccggtttcgtttaaccctttaaccggtaaccccg

SEQ ID NO: 346393 - DNA, 689 bp, Homo sapiens
  misc_feature: GZ8MTXP01AXH5A.21.65.F10.1.454.CMB.2.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgtagcagcaacttagcctggaccagcaagaaacctggaccagccctccgaggcctcctcatctagtgggtnccactcccgacgagggccacgtggaactccccgagcccgtaggttccaggtcggactacggtggggtccgtaggggaactaaggtacgttccaaccttcctaccaaccctatccgaacgccaacggtcccttagggacctaggttaccgtaggtaaagtttagtttttaaggtaaagttttttctttccgttggttcgtacggtaacctaaggttaaacctaagttcgaagggtttccgggtacccgttccggggtaacccggttaccgggaaccggtaaacggggtaaccgtaaagggttacgggaaaacttacggaaaacggtaccgttagggttcggttaccgtaacggacctaaccctagttccttacgttccttcgtaacccg

SEQ ID NO: 346394 - DNA, 598 bp, Homo sapiens
  misc_feature: GZ8MTXP01DR8VF.21.65.F10.1.454.CMB.2.raw
  modified_base (308)..(308): a, c, t, g, unknown or other
  misc_feature (308)..(308): n is a, c, g, or t
  modified_base (462)..(462): a, c, t, g, unknown or other
  misc_feature (462)..(462): n is a, c, g, or t
  modified_base (578)..(578): a, c, t, g, unknown or other
  misc_feature (578)..(578): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcagggccagtcagagtgttagcagacaacttagccctaggaccagacaagaaacctggaccagccctcccgaggcctcctcatctagtggtcncacgtcccgcgacgggccacgtggaactcccgagccgtaggttccaggtcggactacggttcggggtcgtacggggaactggtacgtttcccaacttcctaccacctatccacgcacgcctgctagtctaggtaattagtttagtaaagttttnttcgtgttctagactaagtactaatcgtaggtcgaccgtcggtaccgttacggaccgaagggaaccgtaaggttacgaaacttacgaaacgtcgttggttcgctcgactaaccgtntcttagttccttcgtaaccg

SEQ ID NO: 346395 - DNA, 520 bp, Homo sapiens
  misc_feature: GZ8MTXP01DZCCY.21.65.F10.1.454.CMB.2.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (347)..(347): a, c, t, g, unknown or other
  misc_feature (347)..(347): n is a, c, g, or t
  modified_base (499)..(499): a, c, t, g, unknown or other
  misc_feature (499)..(499): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccagggganagagccacctctcctgcagggccagtcagagtgttagcagcaacttagcctggtaccagcagaaacctggccagcctccaggctccnatcatggtncatccgcagggccagtggaactccagccaggttcagtggctagtgggtctaggggacnggtacgttcactctccacatcagcagcctgctagtctagaatatttgaagtttattctgttctgtctagtacatcagtcggacctcggtacgttcggacgaagggaacaagggttagaaacgttacgaaagtaacgttggttgacctgaccnctatcttagttccttctaacc

SEQ ID NO: 346396 - DNA, 582 bp, Homo sapiens
  misc_feature: GZ8MTXP01AMN3T.21.65.F10.1.454.CMB.2.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (563)..(563): a, c, t, g, unknown or other
  misc_feature (563)..(563): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccaccctgtctgtgtctccgaggggagagagccaccctctcctgcagggccagtcagagtgtagcagcaacttagcctggaccagcaagaaacctggccagccctccgaggcctccncatctatggtncatccgcgagggccagtggaactccccagccgtaggttccaggtcggctacggtcgggggtctaggggaccaaggacgtttccaacttcctacaccagtcacgctacgcctgactagtacgtagtaaagtttagttttagtaaagttttcttcgtgttacgtgtacgtagtaactaagtcgtaggtcggtaccgtcggtacggtcgacgaacgggaacgtaaaggttgaaattacgaaaacgtgttggttcgacgtgccaacgtntcgttacttcttaactccg

SEQ ID NO: 346397 - DNA, 515 bp, Homo sapiens
  misc_feature: GZ8MTXP01A22TO.21.65.F10.1.454.CMB.2.raw
  modified_base (194)..(194): a, c, t, g, unknown or other
  misc_feature (194)..(194): n is a, c, g, or t
  modified_base (291)..(291): a, c, t, g, unknown or other
  misc_feature (291)..(291): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccagggganagagccaccctctcctgcagggccagtcagagtgttagcagcaacttgcctggtaccagcagaacctggccagcctccaggctcctcatctatggtncatccgccagggccacgtggaactcccagccaggttcagtcgcacgtgggtctgggaacagcgttcactctcaccatcagcagcctgcagtctagaagtnttttgaagttttattctgttcnggcagtacaatcagtcggcctcgggacgttcggaccaaggggaccaagggtgaaactcaaacgaacgtgttggcttgcaccaatctgttcttcaacgttccc

SEQ ID NO: 346398 - DNA, 543 bp, Homo sapiens
  misc_feature: GZ8MTXP01DKT55.21.65.F10.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggganagagcccaccctctcctgcagggccagtcagagtgttagcagcaacttagcctggtaccagcagaacctggccagcctccaggctcctcatctatggtncatcccgccagggccacgtggaactcccagccaggttcagtggcacgtgggctgggacnggattccactctcaccatcagcagcctgctagtctagaagtattttagaaagttttnttctgttctggtactaagttacaagtcgaggtcggaccctgggtaccgtttcgggacccgaaaggggaaccaaagggttaggtaaattacgaaaacgtagttgttggctgacaacctatcttgtcttctaac

SEQ ID NO: 346399 - DNA, 576 bp, Homo sapiens
  misc_feature: GZ8MTXP01B1EYF.21.65.F10.1.454.CMB.2.raw
  modified_base (194)..(194): a, c, t, g, unknown or other
  misc_feature (194)..(194): n is a, c, g, or t
  modified_base (290)..(290): a, c, t, g, unknown or other
  misc_feature (290)..(290): n is a, c, g, or t
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggcctcccagaaagctctggagaaatagtgatgacgcagtctccagccacctgtctgtgtctcgagggganagagccaccctctcctgcagggccagtcagagtgtagcagcaattagcctggtaccagcagaacctggccagcctccagcctcctcatctatggtncactccgccagggcccagtggaactccagccaggtcagtcggcagtgggtctgggaacagtgttcaactctacaccatcancagcctgctagtctaggtaattnttttgaaagttttnttcgtgttctggactaagtaacagtcgtacggtccggtacgttaccgggtacgtaccggaccgtaaacgggtaaccgtaaagggtaacgaaacgtaaacgaaacggtaacgtcggttacggcttacgaacctaccgtaacttcgtcgtttacctcgttaacgttcccg

SEQ ID NO: 346400 - DNA, 744 bp, Homo sapiens
  misc_feature: GZ8MTXP01AWU3A.21.65.F10.1.454.CMB.2.raw
  modified_base (198)..(198): a, c, t, g, unknown or other
  misc_feature (198)..(198): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
tcagtcgtcgctcgcacgaccggtgctcgatttagctacgctctaaggggggaggaactgctcagttaggacccagacggaaccatggaagccccagcgcagcttctcttcctcctgcttctctggctcccagacaccactggagtgattgtgatgacgcagtctccagccaccctgtctgtgtctccgaggggggancgcccaccctctcctgcacagccagtcagtctatcgctgactgggttacncctggtaccagcagaaancgtggccaggcctcccgaggtcctcctctactttaccgtgccactcccaccgacgggccctacgttggtccgtaccccaaggtactacgggttcaacgggtcggggtcgggttagggtagttttcggggaaacttaggttcgttttcctccgtaccacccgtagtccgacggacccgtacccttaacgaggtaggtaggtaaagtgtttggtttacgtactttaggttttactttaccgtacgggtaccctaaggtaccgtaaatttaacgtttaaactttaccggtaccgggtcccgttgggtacccggtttacccgggtaaccggtttaccccggggacccgtaaacccgggggtaacccgtaaaggggttaacgggaaaacctacggttaaaaccggtaaaccggttggttacgggccttacggaaccctaaccggttaacttcgttcgttaccttaacgttaacgtttcccccg

SEQ ID NO: 346401 - DNA, 585 bp, Homo sapiens
  misc_feature: GZ8MTXP01DSB2O.21.65.F10.1.454.CMB.2.raw
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagccctaggtaccagcagaaacctggccagcctccagctccncatctatggtncactccgcagggccacgtggaactcccgagccaggttcaggtgacacgtgggtctagggacngtagttcactctacacatcagcagcctgctagtctagtaagttattttagaaagttttnttcgttgttctggactaagttaccaaagtccgtaggtcggtacccttcgggtaccgttccgggaccgtaaacggggaacctaaaggggttacgggaaaacttcgaaaaaccggtcgttaggcggttacgtaagacctaacccgtatcgttacgttccttcgttaaccc

SEQ ID NO: 346402 - DNA, 714 bp, Homo sapiens
  misc_feature: GZ8MTXP01DQ00F.21.65.F10.1.454.CMB.2.raw
  modified_base (367)..(367): a, c, t, g, unknown or other
  misc_feature (367)..(367): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaagctctggagaaatagtgatgacgcagtctccagccaccctgtctgtgtctccaggggagagagcccaccctctcctgcagggccagtcagagtgttagcagcaacttagccctaggaccagcagaaacctggccagcctcccaggcctcctcatctatggtgcactcccgcgagggccacgtggaactcccagcctaggttccaggtcggactacgtggggtcctaggggacnggtacgtttccaccttcctaccaacctaatccaacgctacggtccctggtcctaaggttaccgttaggtaaagtttagtttttaggtaaaagtttttacttttcgttcggttcctttaggtaccttaaacgtttaacctaaagtttcccgtaaaggggtttccgggtaccccgtttaccggggtaacccgggttttaccggggaacccggtaaaacggggggtaaaccccgttaaaaggggttaacgggaaaaacttaaaccggaaaaacggttaaccgttagggttcggggaccttcgggaacctaacccttaacgttcgttacgttccgttttaaccgtaacccg

SEQ ID NO: 346403 - DNA, 663 bp, Homo sapiens
  misc_feature: GZ8MTXP01A50BJ.21.65.F10.1.454.CMB.2.raw
  modified_base (301)..(301): a, c, t, g, unknown or other
  misc_feature (301)..(301): n is a, c, g, or t
  modified_base (644)..(644): a, c, t, g, unknown or other
  misc_feature (644)..(644): n is a, c, g, or t
  modified_base (651)..(651): a, c, t, g, unknown or other
  misc_feature (651)..(651): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaactagcctggtaccagacagaaacctggccacgccctccgagcctcctcatctagtggtcncactcccgacgacgggcccacgtggactccccgagcccgtaggttcgacgtcggctacgtggggtccgtaaggggacaaggtagttccaaccgttcctaccacctatacccgagccacgcccgtggaccaggttaccgttaaggtaaagtttcgtttttaggtaaaacgtttttctttcgtttacggttcttacggtacgtaaagttaccaaagtttcgaacgggttcggtaccccgttacggggtaccggttaccggggaacccgtaaagggggtaacccgtaaaggggttacgtaaaacaccggtaaaacggtacgttggttcgacgttgacctaaccgtntccgttntctttcgaaccg

SEQ ID NO: 346404 - DNA, 554 bp, Homo sapiens
  misc_feature: GZ8MTXP01BJ524.21.65.F10.1.454.CMB.2.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
  modified_base (418)..(418): a, c, t, g, unknown or other
  misc_feature (418)..(418): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcaagaaacctggccagccctccaggctccncatctatggtncactcccgcacgggccacgtggaactcccagcctaggttcacggtggcacgtgggtctaggggacngtacgtcactctacacatcagcagcctgcagtctagtaattatttagaagttttnttcgtgttctgactagtacatcaggtcggccgttggtaccgttcggaccgaaagggtaacctaaggggttaggtaaacttcgaaaacggtacgttaggttcggctggaccaacctagtccttggttcttctaaccg

SEQ ID NO: 346405 - DNA, 546 bp, Homo sapiens
  misc_feature: GZ8MTXP01BNX8O.21.65.F10.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccaccctctcctgcagggccagtcagagtgttagcagcaattagccctggtaccagcagaaactggccagccctccaggctccncatctatggtncatcccgccagggccacgtggaactcccagccaggttcagtcggcacgtggggtcctaggggacnggacttcactctcaccatcagcagcctgcagtctagtaatnttttagaaagttttnttctgttctggtactaagtacaatcagttcggccctgggtacgttcggaccgaagggaaccaagggttaggaaacttacgaaaacggtacttggttcggctgccaacctatcgttacgttctttcgtaacc

SEQ ID NO: 346406 - DNA, 615 bp, Homo sapiens
  misc_feature: GZ8MTXP01CKSX2.21.65.F10.1.454.CMB.2.raw
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccacccctctcctgcagggccagtcagagtgtagcagcaacttgcctggtaccagcagaacctggccagccctcccgaggcctcctcatctagtggtcncacgtcccgccgacgggcccacgtaggaactccccgagccgtaggttccaggtcggcacgtcggggtctaggggacnggtacgttccactctacaccgtatccacgcacgtcctgcgtagtcgtagtaaagttattttagtaagttttattcgttagttcttgactaagtactaatcgtaggtcggtcccgtcggtaccgttaccgggaccgaacgggtaaccgtaaagggttacggaaaacttccgtaaaacgtcgttggttcgggccttaacggacctaaccgtacgttcgttacgttccgttcgttaacccg

SEQ ID NO: 346407 - DNA, 591 bp, Homo sapiens
  misc_feature: GZ8MTXP01DJSS7.21.65.F10.1.454.CMB.2.raw
  modified_base (195)..(195): a, c, t, g, unknown or other
  misc_feature (195)..(195): n is a, c, g, or t
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggaccagcagaacctggccagccctccgaggcctcctcatctagtggtncactcccgcagggccacgtggaactcccgagccaggttcacggtcggacacgtggggtctaggggactggtattccacttcaccactatcagcacgcctgcagtctagtaattntttagtaagttttatttcgtagttcgtcgtactaagtacaagttcgtaggtcggtacccgtcgggtaccggttcgggaccgtaaaggggaaccgtaaaggggttacggaaaacttaccgaaaaccggtagttgggttcggactcggaccaaccttagtcgttcgttccgttcgtaacccg

SEQ ID NO: 346408 - DNA, 569 bp, Homo sapiens
  misc_feature: GZ8MTXP01AYZHT.21.65.F10.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgtagcagctaattgcctggtaccagcagaactggccagcctccagctcnatctatggtncatccgcagggccacgtggaactcccagcctaggttcagtcggcacgtgggtctagggacngngttcactctcaccatcagtcagcctagcagtctagaagtattttgaagttttattctggttactgaccgtaagtacaagtccgagtcgggtccccttggggtaacgttccgggaccgaaggggaaccctaaagggttgggaaaacttccggaaaacgtaacgttcggttacggcttaacggacctaaccgtagtcctttgtcccgtttcgtaaccg

SEQ ID NO: 346409 - DNA, 633 bp, Homo sapiens
  misc_feature: GZ8MTXP01EJESI.21.65.F10.1.454.CMB.2.raw
  modified_base (195)..(195): a, c, t, g, unknown or other
  misc_feature (195)..(195): n is a, c, g, or t
  modified_base (297)..(297): a, c, t, g, unknown or other
  misc_feature (297)..(297): n is a, c, g, or t
  modified_base (434)..(434): a, c, t, g, unknown or other
  misc_feature (434)..(434): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagagccaccctctcctgcagggccagtcagagtgttagcagcaacttagcctggaccagcaagaaacctggccacgcctccaggcctcctcatctagtggtncactcccgcgagggcccacgtggaactcccgagccgtaggttcaggtcggcacgtggggtctaggggacaaggtcttcacttctacacatcagcacgcctagcctagttactagtaaagttgttttagaaagttttntttcgtgttactagacttaagtaacctaattccgacggttcggtaccccgttaggggtaccgttaccgggacccgaaaacgggggtaaccgtaaaggggttaaacgtaaaacgttaaccgaaaaacggtaacgttgggttcggttaccgttaacggaccctaaccgttacgtccttacgtttccgtttaacctaacccg

SEQ ID NO: 346410 - DNA, 623 bp, Homo sapiens
  misc_feature: GZ8MTXP01D6CTP.21.65.F10.1.454.CMB.2.raw
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgttagcagcaacttagccctaggtaccagacagaaacctggaccagccctccaggctcctcatctatggtncatccgcagggccacgtggaactcccagccaggttcaggtggcacgtgggtctaggggacnggtacgttccacttctaccacctatccagcaggtcctgcctagttctagtaagtattttagaagttttatttcgtgttactggtacctaagttaaccaagttcgacggttcgggaccgttaccggggtacggtttacgggacccgaaacgggggtaaacctaaaggggttaacgggtaaacgttaaccgaaaaacggtaaccgttgggttcggaccgttggaccctaaccggtacttcgttcgttaaccgtttcgttaacccg

SEQ ID NO: 346411 - DNA, 646 bp, Homo sapiens
  misc_feature: GZ8MTXP01D3SAW.21.65.F10.1.454.CMB.2.raw
  modified_base (311)..(311): a, c, t, g, unknown or other
  misc_feature (311)..(311): n is a, c, g, or t
  modified_base (498)..(498): a, c, t, g, unknown or other
  misc_feature (498)..(498): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccaccctgtctgtgtctccgaggggagagacgcccaccctctcctgcagggccagtcagagtgtagcagcaacttgcctggtaccagacaacgaaacctggaccacgccctccgaggtcctcctacattctagtcgggtcnccacgtcccgacgacgggcctacgtacggaacctcccgacgccgtaaggttccacggtcggacgtacggttcggggtacgtaaggggaacctaaggtacgtttacccaaccttccaccaacccgatcccacggacacggtcctggacctagttaccgtaagtaagtttagttttagaaacgtttttntttacgtgttactgtactaacgttaacagttccgtaggtcggtacccgtacgggtaccgttcggaaccgtaaaggggtaaccaagggttaacggaaacttacgaaaacgtacttggacgttctcgacaacgtatcttgttcttctaac

SEQ ID NO: 346412 - DNA, 601 bp, Homo sapiens
  misc_feature: GZ8MTXP01BPXUE.21.65.F10.1.454.CMB.2.raw
  modified_base (298)..(298): a, c, t, g, unknown or other
  misc_feature (298)..(298): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggaccagcaagaacctggccagccctccgagcctcctcatctagtggtncactcccgccagggcccacgtggaactcccgagcctaggttcaggtcggcacgtgggtcctggggacaaggtcgtcactctacaccatcagcacgcctgcctagtacgtagtaattagttttagaagttttattcgtgttacgtggtactaagtaacctaagtcgaggtcggtacccgtacgggtaccggttaccggacccgaaaggggtaacccgtaaagggttacgggaaaacttaccgtaaaacggtaccttagggttcgacgttcgcctaacctagttccttacgttctttcctaaccg

SEQ ID NO: 346413 - DNA, 703 bp, Homo sapiens
  misc_feature: GZ8MTXP01DU3W4.21.65.F10.1.454.CMB.2.raw
  modified_base (196)..(196): a, c, t, g, unknown or other
  misc_feature (196)..(196): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcgagggccagtcagtagtgttagcagactaacttacgccgtaggtaccagacaacgaaacctcggaccacgccctcccgaggcctcctcatctagtggtcgcacgtcccgaccgacgggccacgtacggaacctccccgagccgtaggttcgacggtcggacgtacggttcggggtacgtagggaactaagggtacgtttaccacctcctaccaccgtacacgacgcacggtccctagtaccctaaggttacgttaagggttaaattttagtttttaagggtaaaacttttttcgtttcttcgggttacttaggtacctaaagttaactaatccggtaacggtcgtaccccgttcgggtaaccggttcccgggaacgtaaacggggaaccgttaaaggggacgtaaaacgttaccggtaaaacgtaaccgttgggttcgttaccgtaacgtacccaacggtacttcttacgtccgtttaactaacccg

SEQ ID NO: 346414 - DNA, 607 bp, Homo sapiens
  misc_feature: GZ8MTXP01CAN6S.21.65.F10.1.454.CMB.2.raw
  modified_base (299)..(299): a, c, t, g, unknown or other
  misc_feature (299)..(299): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctggtaccagcaagaacctggccagccctccgaggcctcctcatctagtggtcncactcccgcacgggccacgtcggaactccccgagccgtaggttcacggtcggctacggtggggtcgtaaggggacctggtacgttccaaccgttcaccaccatcgagcacgtcctgactagtactagtaagttattttagtagttttattcgtgttcgtgtactaagtactaatcgtaaggtcggtacctccgggtacgttcggaaccgaacggggtaaccgtaagggttaggaaacttacgaaaacggtaccgttaggttcggactaacggactaacccgtagttccgttagttcctttcgtaaccc

SEQ ID NO: 346415 - DNA, 583 bp, Homo sapiens
  misc_feature: GZ8MTXP01D6U3M.21.65.F10.1.454.CMB.2.raw
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctaggaccagcaagaaaccctggccacgccctccaggcctcctcatctatggtncactccgcgagggccagtggaactcccgagccgtaggtcacgtcggcacggtgggtctagggacnggtacgttcactctacaccatccagccaggccctgacgagttacgtagtaagttacttttagaaagttttnttcgtgttccgtagacctagtaaccaatcgaggttcgcccgtaggtacggttccggaccgaagggaacccgtaagggagaaacgttacgaaacggacgttggcggttaccgtgacctaaccgtacttcgttcgttccttcgtaacccg

SEQ ID NO: 346416 - DNA, 595 bp, Homo sapiens
  misc_feature: GZ8MTXP01C9BG9.21.65.F10.1.454.CMB.2.raw
  modified_base (197)..(197): a, c, t, g, unknown or other
  misc_feature (197)..(197): n is a, c, g, or t
  modified_base (261)..(261): a, c, t, g, unknown or other
  misc_feature (261)..(261): n is a, c, g, or t
  modified_base (378)..(378): a, c, t, g, unknown or other
  misc_feature (378)..(378): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagaccaccctgtctgtgtctccgagggganagacgccaccctctcctgcgagggccagtcagagtgttagcagactaacttagcctaggaaccngacaagaaacctggaccacgccctcccgaggcctcctcatctagtcgggtcacactcccgacgacgggccagtacggaactcccgagcctaggtcaggtgcacgtggcgtagggacngtacgtcacttcacacgatccagtcagcctgacagtctagattatttagtaagttttctactgtctgtactaagtaacaagttcgacggttcggtaccgttcgggtaacgttacccgggacgtaaacgggggaacctaaagggggttagaaaacttacgaaaacggtacttggttcggacctgacccaacgtattccgttagttccttaacttcccg

SEQ ID NO: 346417 - DNA, 596 bp, Homo sapiens
  misc_feature: GZ8MTXP01A2M0M.21.65.F10.1.454.CMB.2.raw
  modified_base (387)..(387): a, c, t, g, unknown or other
  misc_feature (387)..(387): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
  modified_base (579)..(579): a, c, t, g, unknown or other
  misc_feature (579)..(579): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccaccctctcctgcagggccagtcagagtgtagcagcaacttagcctggtaccagcaagaacctggaccagccctcccgaggcctcctcattctagtgggtcgcactccccggaccgacggggcccaacgtggaacctccccgagccctaaggttccaggttcggcacggtggggtctaggggaccnggtacgttcactctcaacatcgagcacgcctgcctaggtctagtaaagttntttttagaaacgttttttnttcgtgttcgtagtacgtacgtaactagtcgacggtcggtaccgtcgggtacgtcggaaccgaacgggtaacgtaagggttagaaacttacgaaacgtacgttggttcgctcgactaacgtntccttgttccgttctcg

SEQ ID NO: 346418 - DNA, 556 bp, Homo sapiens
  misc_feature: GZ8MTXP01D57R6.21.65.F10.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (540)..(540): a, c, t, g, unknown or other
  misc_feature (540)..(540): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccaccctctcctgcagggccagtcagagtgttagcagcaacttagccctggtaccagcagaaactggccagcctccagctcctnatctangtncactcccgcagggccacgtggaactcccagccgaggttcacgtgcacgtggtctagggacnggtntcactctcactatcagctacgctgcagtactagtaatagtttagtaagtttattctgttctgtactaagtactaagtcctaggtcgtccgttacgggtaccgtttcggaaccgtaagggaaaccctaagggttagaaacgttcgaaaacggtacttggttggacttgaccaacctatccgttnttccgttcgtaacccg

SEQ ID NO: 346419 - DNA, 813 bp, Homo sapiens
  misc_feature: GZ8MTXP01DWA6Q.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggaagaaatagtgatgacgcagtctccagccaccctgtctgtgtctccgaggggagagacgcccacctctcctgcgagggccagtcagtagtgttagcagactaacttgcctggtaccagacaacgaaacctcggaccacgccctccgacgcctcctacatctaagtcgggtcacctacgtcccggacgacgggggacccctacggttacggaacctccccgaggacccgtaagggtttccgaacggttcgggactacgggttcggggtcgtaaggggaactaacgggtacgtttccaacccttcgtaccaaccctaaagtcccgaaggccctaacggtccctacgtaccgtaaggtttaccggtagttaaaagtttgttttttagaaaacgttttttgtttcgtacgttacgttacggtaacttaaacgttacgtaaacgttccgggtacgggttcccggttaacccgggtaccggggttaacccggttaacccggggaaacccgggtaaaaccgggggtaaaccggtaaaggggttaaaacgggtaaaaaccggttaaaccggtaaaaccggggttaacgttacggggttccggttaaccggttaaccgtaaccccgttaaaccgttacgttaccgtttacccgtttaaccgttttaaccccgtaaccccg

SEQ ID NO: 346420 - DNA, 608 bp, Homo sapiens
  misc_feature: GZ8MTXP01C75KV.21.65.F10.1.454.CMB.2.raw
  modified_base (304)..(304): a, c, t, g, unknown or other
  misc_feature (304)..(304): n is a, c, g, or t
  modified_base (479)..(479): a, c, t, g, unknown or other
  misc_feature (479)..(479): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaagctctggagaaatagtgatgacgcagtctccagccaccctgtctgtgtctccgaggggagagagcccaccctctcctgcgacgggccagtcagagtgttagcagcaacttagcctggaccagacaagaaacctggccacgccctcccgaggcctcctcatctatggtcncactccgccgagggccacgtggaactcccgagccgtaggtccagtcggcacggtggggtctaagggactaaggtacgttccacgtcctccaacctatcagtccacgcctgactagtcgtagtaagttgttttagtaagttttacttcttgttacttcgacttaagtacaattcgnggttacggccgtacgggtaccgttcggaaccgaagggaaccgtaaagggttaggaaaacgttacgtaaaacggtacgttcggttcggttaccgtcgacctaaccgtatccgttcgttccttcgtaaccg

SEQ ID NO: 346421 - DNA, 695 bp, Homo sapiens
  misc_feature: GZ8MTXP01EDUH3.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcgagggccagtcagagtgttagcagcaacttagcctaggtaccagcagaaacctggccagccctccgaggcctcctcatctagtggtcgcacgtcccgaccgtacgggggccccaaccgtagggaaacctcccccgaacgtcccgtagggtttaccaaggggttcgggaccgtaacggttcgggggttaccgtaggggggaacctaaggggttacgtttacccacccttcctacccaaccgtattaccaacgccgaacggcccttggacctaagttacttaggtaaagttatttttggaaatttttgtttcgtgttcttaggctaacgtacaattcgagttcggaccgttcgggtaccggttacggaccgtaaggggaaccgtaagggttaacggaaacgttaacgaaaacggtaacgttggttcgggttacctaacggtaccgtaacctcgttaccgttcgtttaaccgttcgttaacccg

SEQ ID NO: 346422 - DNA, 634 bp, Homo sapiens
  misc_feature: GZ8MTXP01D9MSN.21.65.F10.1.454.CMB.2.raw
  modified_base (306)..(306): a, c, t, g, unknown or other
  misc_feature (306)..(306): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtcctccgaggggagagacgcccaccctctcctgcgagggccagtcagagtgtagcagctaacttagcctggtaccagcaacgaacctggaccacgccctcccgagcctcctcatctagtggtcnccacgtccccgacgagggcccacgtacggaacctccgagcctaggttcaggtcgctagtgggtctgggaacagtcgttcactctacacatcagcagtcctgctagtctagtaatttatttagtaagtttcttcgtagttaccgtggtaaccttagtaacctaagttcgaagttccgggtcccgttaaccgggtaccggttacccggaaccggtaaacggggtaccgaaaaggggttacgaaaacttacccggaaaaacgtacggttggaccggttccttacggaaccctacctaagttccgtagttcctttaacaaccgtttcccccg

SEQ ID NO: 346423 - DNA, 519 bp, Homo sapiens
  misc_feature: GZ8MTXP01BT6TC.21.65.F10.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (359)..(359): a, c, t, g, unknown or other
  misc_feature (359)..(359): n is a, c, g, or t
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccacctctcctgcagggccagtcagagtgttagcagcaacttagcctggaccagcagaacctggccagccctcccaggcctcctnatctatgggtncatcccgccagggccacgtggaactcccgagccaggttcaggtggcacgtggggtctggggacngtagttcactctcaccatcagcagcctgcagtacgtagtaagtattttgaagttttattctgtctgacagtacaatcagtggacctggcttggaccaagggaacaagggttgaaattacgaaacgtacttgttggncgacaacctattnttctcttcgtc

SEQ ID NO: 346424 - DNA, 561 bp, Homo sapiens
  misc_feature: GZ8MTXP01AZDK6.21.65.F10.1.454.CMB.2.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (364)..(364): a, c, t, g, unknown or other
  misc_feature (364)..(364): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtagcagcaacttagcctggtaccagcagaacctggccagccctccaggcctcctnatctagtggtncatcccgcgagggccacgtggaactcccgagcccgtaggttcaggtggctacgtgggtctagggacngtacgttcactctacactatcagcacgcctgactagtctagaagtntttagaagttttnttctgtctgtactagtacaagtcgaggtcggccgtcggtacgttcggaccgaaaggggaacctaaagggttagaaaacttcgaaaacgtcgttggttcggctaacgactaacctagtcgttacgttccttcgtaaccg

SEQ ID NO: 346425 - DNA, 516 bp, Homo sapiens
  misc_feature: GZ8MTXP01CNS5O.21.65.F10.1.454.CMB.2.raw
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (494)..(494): a, c, t, g, unknown or other
  misc_feature (494)..(494): n is a, c, g, or t
tcagtcgtcgctcgcacgaccggtgctcgatttagctacgctctaagggggaggaactgctcagttaggacccagacggaaccatggaagccccagcgcagcttctcttccttctgctactctggctcccagaaagctctggagaaatagtgatgacgcagtctccagccaccctgtctgtgtctccgaggggagagagccaccctctcctgcagggccagtcagagtgtagcagcaacttagcctggaccagcaagaacctggccagccctccagctcnatctatgtncatccgcgaggccagtggactcccagccagttcacgtggcncgtgggtctagggacngacgttcactcncaccntcagcagcctgctagtctagtaatgtttagaattttnttctgtcgtgactagtacaatcgagtcgacctggtacgttcgaccgaagggaacctaaggttggaaaacttcgaaaacgtattggcggctgacnccgtatcttgttcttcgtaacc

SEQ ID NO: 346426 - DNA, 586 bp, Homo sapiens
  misc_feature: GZ8MTXP01AD9ZI.21.65.F10.1.454.CMB.2.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (579)..(579): a, c, t, g, unknown or other
  misc_feature (579)..(579): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagcccaccctgtctgtgtctccgagggganagacgcccaccctctcctgcagggccagtcagagtgtagcagcaacttgcctggtaccagcagaacctggccagcctccgaggcctcctcatctagtggtcncacgtccccgcgagggccacgtggaactcccagcctaggttcaggtcgcagtgggctgggaacngtcgttcactcaccaccatcgacgcacgccttagccgtagttcgtaaggtaacgtttagtttttagtaaggtttttacttcgttgttccttagggtactaagttaaccaagttcgtaggtcgtacccggtcgggtaccgttcgggaacgaaacggggtacgtaaagggtacgaaatcgaaacgtacgtgttcggcttcgcacctaagtctgttctcngtccccg

SEQ ID NO: 346427 - DNA, 546 bp, Homo sapiens
  misc_feature: GZ8MTXP01EWSJD.21.65.F10.1.454.CMB.2.raw
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (527)..(527): a, c, t, g, unknown or other
  misc_feature (527)..(527): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctggtaccagcagaaacctggccagcctcccaggctcctcatctatggtgcatcccgccaggggccactggaactcccgagcccaggttcaggtggcagtgggtctagggacnggtacgttcactctcacatcagcagcctgcagtcagtaatnttttagaagttttattcgtgttctgtcctagtacaatcgagtggacccgttcggtacgttcggaccgaaagggaaccgaaagggttggaaaacttcgaaacgtaacttgggttacgctgactaaccgnttacgttgtcctttgaacc

SEQ ID NO: 346428 - DNA, 664 bp, Homo sapiens
  misc_feature: GZ8MTXP01B0WK8.21.65.F10.1.454.CMB.2.raw
  modified_base (318)..(318): a, c, t, g, unknown or other
  misc_feature (318)..(318): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccacctctcctgcgagggccagtcagagtgttagcagactaacttagccgtaggtaccagacaacgaaacctcggacccacgccctacccgacggtcctcctacacttctagtggtcncgacgtccccggaccgacggggccctaacgtacggaacctccccgaggcccgtaggttccgaggtcggactacggtggggtacgtaacggggactaacgggtacgttaccaccttcctaccaacctagtccagcacgtcctggacctagttacgtaaggtaaagtttagttttaaggttaattttactttcgtacggttcttaggtactaagtaactaacgtccgtaggttcggtaccgtcgggtaccgttaccgggaacggaacgggtaaccgtaaagggttacgtaaaacgttacgaaaacgtacgttggcggctaaggaccaactatcgttctcttaacgtcc

SEQ ID NO: 346429 - DNA, 566 bp, Homo sapiens
  misc_feature: GZ8MTXP01BHLF7.21.65.F10.1.454.CMB.2.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (421)..(421): a, c, t, g, unknown or other
  misc_feature (421)..(421): n is a, c, g, or t
  modified_base (546)..(546): a, c, t, g, unknown or other
  misc_feature (546)..(546): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcaggagtgtagcagcaacttgcctggtaccagcaagaacctggccagccctccaggcctctcatctatggtcncatcccgcagggccacgtggaactccccgagcccgtaggttcaggtggcaggtgggtctagggactgagttccactcgtcacatcagcagcctgccagttctagtaacttatttgaaagttttnttcgtaggtctagcgtaataacatccgaggttcgcccgtgggtaaccgttcgggaacccgaaaggggtaacccaagggttagaaaacgttcgaaaacggtattcggttcggcttcgactaaccgnttcggattccttaacgaacc

SEQ ID NO: 346430 - DNA, 480 bp, Homo sapiens
  misc_feature: GZ8MTXP01BJSSE.21.65.F10.1.454.CMB.2.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (379)..(381): a, c, t, g, unknown or other
  misc_feature (379)..(381): n is a, c, g, or t
  modified_base (386)..(386): a, c, t, g, unknown or other
  misc_feature (386)..(386): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (408)..(409): a, c, t, g, unknown or other
  misc_feature (408)..(409): n is a, c, g, or t
  modified_base (414)..(414): a, c, t, g, unknown or other
  misc_feature (414)..(414): n is a, c, g, or t
  modified_base (416)..(417): a, c, t, g, unknown or other
  misc_feature (416)..(417): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (462)..(463): a, c, t, g, unknown or other
  misc_feature (462)..(463): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccaccctctcctgcagggccagtcagtagtgttagcagcaacttagcctggtaccagcaagaacctggccagccctccaggctcctcatctatggncatccgcagggccatggaactccagccaggtcacgtggcagtgggtctagggacaaggtntcacttcncacctatcagcagcnnntatanatattagttattattntntgtnntatananngtgtcgtcgtcgtcgcgagaacgagagaanacgaacgaanagngnncncnctnttctcttctn

SEQ ID NO: 346431 - DNA, 959 bp, Homo sapiens
  misc_feature: GZ8MTXP01BTCOC.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctcgaggggagagacgccacctctcctgcgacgggccagtcagtagtgttagcagactaacttacgccgtacggtaaccagacaacgaaaccgtcggaccacgccctcccgacggtcctcctacattctagtcggtcgctaccgtcccggaccgtacgggaccctaccgtacggaacctccccgaacggtccgtaaggttaccgaacgggtcgggaccgtaaccgggttgggggttaccggtaacgggggaaacctaacgggtaaacggtttaccccgtaacccgttaccccttaaccggaacccctaaacgttacccgaaccggacccgtaaacggtccccgtacgggtacctaaacgggtttacccgttaaaggggttaaaacgtttttacgttttttaaagggggttaaactttttttaacgtttttccgggttacggttttaccggttaaacggttaacccggtttaaaaccgggttaaactaaaccggtttccgggtaaacggggtttccggggtaacccccggggtttacgggggtaacccgggttttaaccccgggggaaacccggtaaaaaccggggggtaaaccccggtaaaaaggggggttaaaccggggttaaaaaaaactttaaaccccgggaaaaaaaaccgggggttcccgggttaaggggttttccggggacccgttttaacggggaaacccccgtaaccctttaaacggggttaccccttttccggggtttaaccctttttaacccgggtttaaacccccg

SEQ ID NO: 346432 - DNA, 719 bp, Homo sapiens
  misc_feature: GZ8MTXP01AY6BR.21.65.F10.1.454.CMB.2.raw
  modified_base (285)..(285): a, c, t, g, unknown or other
  misc_feature (285)..(285): n is a, c, g, or t
  modified_base (297)..(297): a, c, t, g, unknown or other
  misc_feature (297)..(297): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctggtaccagcagaacctggccagccctccaggcctccncatctatggtcncacgtcccgcgacgggccacgtggaactcccgagcctaggttcacggtggctacggtggggtctacggggacaaggtacgttccaaccgttcctaccgaacccagtccaacgccaacggtcccgtaggccctaaggtttaccgtaaggtaaagttttagtttttaaggtaaaacgttttttactttcgttcggttaccgttcggtaaccttaaaggttaaaccctaaagttcccggtaagggtttccggggtaccccgtttacgggggtaacccggtttacccggggaaccggaaaccgggggtaaacccgtaaagggggttacgggtaaaaacgttacccgaaaaacgggtaaccgttgggttcgggttaccttaacgggacctaacccgttgttccgttacgtttaaccttcgtaacccg

SEQ ID NO: 346433 - DNA, 588 bp, Homo sapiens
  misc_feature: GZ8MTXP01D2JJR.21.65.F10.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (438)..(438): a, c, t, g, unknown or other
  misc_feature (438)..(438): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctcgagggganagagcccacctctcctgcgagggccagtcagagtgtagcagctaattgcctggacagcaagaacctggccagccctccgagcctcncatctatggtncacgtccgacgagggccacgtggaactcccagcctaggttcaggtcggactacggtgggtcctagggactggtacgttccacctcctaccacgtatcgagtcagtccctgcctaagttctaggttaaagttattttagaaagttttnttcgtgttacgtgtactaagtaccaatcgaaggtcgacccgtggtaccgttcggacggaaacgggaacctaaagggttacgaaacttaacggaaaacgttaacgttgggttcgacgtgacctaacgtatcgttgtaacctttcgtaaccc

SEQ ID NO: 346434 - DNA, 631 bp, Homo sapiens
  misc_feature: GZ8MTXP01C13XH.21.65.F10.1.454.CMB.2.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (423)..(423): a, c, t, g, unknown or other
  misc_feature (423)..(423): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctcagccacctgtctgtgtctccgagggganagacgccacctctcctgcagggccagtcagagtgtagcagctaacgttagcctggtaaccagcgaagaacctggccacgccctacccgaggcctcctnactcgtagtcgggtnaccacgtccggaccgacgggtcccacgttacggaacctcccgagtcccgtaggttccacggtggcctaggtcgggtctaaggggaactggtacgttaccacttaccacgaaccgtanacgacgctacgtcgtgactagtactagtaattagtttagtatttctcgtagtacgtagtacgtaagtactagtcgacggtccgtaccgtcggtaccgtacggaaccggtaaacggtaacgtaaaggttaacgtaaacgttacgtaaaccggtcgttcggttcgttacctcgaccttaacgtcgttcgttacgttcccttcgtaacccg

SEQ ID NO: 346435 - DNA, 788 bp, Homo sapiens
  misc_feature: GZ8MTXP01EVJ8S.21.65.F10.1.454.CMB.2.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagctaacttagcctggaccagcaagaaacctggccagccctccgagtcctacctcatctagtcggtcnctactcccggaccgagggggcccctacgtagggaaaccttccccgaaggtcccgtaaggttccgaagggttcgggactacggttcgggggtccgtaagggggaacnggtacgttccgaaccttcctaccaaccgtagtaccacggtccaacggtccctagggcctaagggtttaccgttaaggttaaacgttttaagttttttaggaaacgtttttttacttaccggttgtttacccgggtaagttacccgtaaaggtttaaacccctaaagttcccggtaacgggtttcccggacccggtttaccggggtaaccgtttacccggggaaaccgggaaaacgggggtaaaccccgttaaaagggggttacggtaaaaaaccgttaaaccggtaaaaccgggtaaaccgtttcgggacgttaccccgtaaggaaccccttaaccctaaggtttcccttaacgtttcccgtttaacccgttaacccg

SEQ ID NO: 346436 - DNA, 650 bp, Homo sapiens
  misc_feature: GZ8MTXP01D77JR.21.65.F10.1.454.CMB.2.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcgagggccagtcagagtgttagcagctaacttagcctaggaccagcaagaaacctggcccagccctcccgaggcctcctcatcctagtcggtnctacgtcccgccgacgggccacgtacggaactcccgagcccgtaggttcacggtggactacggtgggtccgtaaggggactaaggtacgtttccacttcccacaacctatacgacgcacgtcctagactagttacgtagtaaagtttagttttagttaaagttttctttcgttacgttcgtacgtacgtaagttaaccaagttcgtaagtcggtcccgttacgggtaccgttcggaaccgggaaacgggtaaccgtaaagggttacgtaaacgttaccgaaaacggtacgttggttcggctaacggacctaactattccgttattaacccgttcgtaacccg

SEQ ID NO: 346437 - DNA, 591 bp, Homo sapiens
  misc_feature: GZ8MTXP01DN2MP.21.65.F10.1.454.CMB.2.raw
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgccaccctctcctgcgagggccagtcagagtgttagcagctaacttagcctggtaccagacaagaacctggaccagccctccgaggcctcctcatctagtcggtncactcccgcgagggccacgtggaactccagccaggttcaggtcggactacgtgggtctaggggacnggtacttcacttcacacntcagcacgctgcagtctagaagttnttttagaagttttntttctagttctagactaagtacaagtcgagggtcgtccgtcgggtaccggttccggaacggaaacggggtaaccgtaaagggttacgggaaaacttaacggaaaaccgtaacgttcggttcggttactaacgacctaaccgtatcgttagttcctttcgtaaccg

SEQ ID NO: 346438 - DNA, 657 bp, Homo sapiens
  misc_feature: GZ8MTXP01BRM8U.21.65.F10.1.454.CMB.2.raw
  modified_base (195)..(195): a, c, t, g, unknown or other
  misc_feature (195)..(195): n is a, c, g, or t
  modified_base (377)..(377): a, c, t, g, unknown or other
  misc_feature (377)..(377): n is a, c, g, or t
  modified_base (631)..(631): a, c, t, g, unknown or other
  misc_feature (631)..(631): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggaccagcagaacctggccagccctccaggcctcctcatctagtggtcgccacgtcccgaccgacggggcccaacgtggaactccccgagtccctaggttccagtcggcacgtggggtctaaggggacnggtacgtccacttcctccaaccattccaagcacgtcccgtgcctagttcgtaagtaagttatttttacggtaaattttcgtttctacggttcttcggtaccgtaagttaacaaagtttcccgaaggggttccgggtacccgttacgggtaccgggtttacccgggacccggtaaggggaaacccgtaaggggttaacggtaaaacttaaccggaaaacgtacggttaggcgggttacctaacggcctaacccgngttcgttcgttccgttccgttaaccc

SEQ ID NO: 346439 - DNA, 861 bp, Homo sapiens
  misc_feature: GZ8MTXP01CF9GM.21.65.F10.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggcctcccagaaagctctggaagaaatagtgatgacgcagtctccagccaccctgtctgtgtctccgagggganagacgcccaccctctcctgcgagggccagtcagtagtgtagcagacaattagcctaggtaccagacaagaaacctggaccacgccctaccgaggcctccacacttctagtggtcaccacgtccccggcgtaacggggccctaacgtacggaacctccccgaaggtcccgtaaggttcacggtcgggactacggtcggggtacctaacggggaactaacggtacgtttaccaaacccttcccctaccaaaccccgtagtacccgaacgtccgtaaccggacccgttgggacccttaaaggtttccgttaaggggttaaaacgtttttaacgttttttaacgggtttaaacgtttttttaacttttacggtttacggtttaccgggttacggttaaacccggttaaaacgtttaaaccgtaaatttcccggtaaacgggggtttccgggttaaccccggtttaccgggggttaaacccgtttacccgggggtaaaaccccgggaaaagggggtaaaacccgggtaaaggggttaaacgggtaaaaaaccttaaaccggtaaaaaaccggttaacccggtttagggttacccgggttaaccgttaacgggtaaccccaacccgttaaacttttccggccgtttttaacccgttcctttaaccccgg

SEQ ID NO: 346440 - DNA, 658 bp, Homo sapiens
  misc_feature: GZ8MTXP01B3590.21.65.F10.1.454.CMB.2.raw
  modified_base (414)..(414): a, c, t, g, unknown or other
  misc_feature (414)..(414): n is a, c, g, or t
  modified_base (473)..(473): a, c, t, g, unknown or other
  misc_feature (473)..(473): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgcccaccctctcctgcagggccagtcagagtgttagcagctaacttgcctaggaccagcaagaacctggaccacgccctccgaggcctccacatctagtggtcgcacgtcccgaccgacgggcccacgtacggaacctcccgagccgtaggttcacggtcggacgtacggtggggtctaaggggaactaaggtacgtttccaccttccaccaaccngtaccgagtcacgtccgtgacgtagttacgtagtaacgtttattttagtaacgtttttnttcgtgttcgtacgtaacgtaagtaactagttcgtacgggttccggtacccggttacgggtaccggttaccggaaccggtaaacgggtaaacggtaaagggttaacgtaaacttaacggaaacggttacgttggttcgacgtcgaccctaacgttacgttccgtttacgttcccttcgtaacccg

SEQ ID NO: 346441 - DNA, 616 bp, Homo sapiens
  misc_feature: GZ8MTXP01CZYD8.21.65.F10.1.454.CMB.2.raw
  modified_base (596)..(596): a, c, t, g, unknown or other
  misc_feature (596)..(596): n is a, c, g, or t
  modified_base (609)..(609): a, c, t, g, unknown or other
  misc_feature (609)..(609): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcctagaaagctctggagaaatagtgatgacgcagtctccagccaccctgtctgtgtctccgaggggagagacgcccaccctctcctgcagggccagtcagagtgttagcagcaacttgcctggtaccagcaagaaacctggccagccctcccaggcctcctcatctagtggtcgctacgtccccgccgaaggggcccaacgtcgggaactccccgagcccgtaggttcacggtcggccgacgttggggcctgggggaaacctaggtcgttccaacttctaccaccgatcgacgcacgcctggctagttcaggtaagttattttaggaaattttcttcgtagttctagggtactaagttaaccaagtcgtagggtcgtccgttacggggtaccgttccggaacggaacggggacctaaaggggtaggaaactacgaaaaccggtaatgggacgttcttgaaccaccgttnttcgtcttcctcncgttccc

SEQ ID NO: 346442 - DNA, 615 bp, Homo sapiens
  misc_feature: GZ8MTXP01BJNWD.21.65.F10.1.454.CMB.2.raw
  modified_base (196)..(196): a, c, t, g, unknown or other
  misc_feature (196)..(196): n is a, c, g, or t
  modified_base (304)..(304): a, c, t, g, unknown or other
  misc_feature (304)..(304): n is a, c, g, or t
  modified_base (472)..(472): a, c, t, g, unknown or other
  misc_feature (472)..(472): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagctaacttagcctaggaccagcaagaacctggccacgccctccgagcctcctcattctagtggtcncacgtccccgaccgacggggccctacgtggaacctccccgaggccctagggttcacggtggactacggtggggtctaacgggggactaaggtcgtttaccacttcctacacctatcccagccacgtcctggactagttcgtagtaaacgtttgttttagtaagttttnttcgtgttctgatagtacatcgagtcggcctcgggtacgtacggaccgtaagggaaccgtaaagggttacgaaacttacgaaacggtacgttgggcgttacgtcgacccttaacgcgtttccgttacgttccttccgtaaccg

SEQ ID NO: 346443 - DNA, 558 bp, Homo sapiens
  misc_feature: GZ8MTXP01ADJF4.21.65.F10.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccaccctgtctgtgtctccgagggganagagccaccctctcctgcagggccagtcagagtgttagcagcaattgcctggacagcaagaacctggccagcctccgagctcctnatcatggncatccgacgagggccagtcggaactcccgagtccaggttccaggtggcaggttcgggtctaagggacngtacgttccactctacacatcagcagcctgcagtctaggtaagtnttttaggatttattctgtacttgactagtacaatcgagtcggtcctacgggtcgtacggaaccgaagggtaaccgaaagggttacgtaaacgttacgtaaacgaacttgggacgcgtaacgactaacgacgttcttcggttaaccttcgtaaccc

SEQ ID NO: 346444 - DNA, 682 bp, Homo sapiens
  misc_feature: GZ8MTXP01CW2OS.21.65.F10.1.454.CMB.2.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (468)..(468): a, c, t, g, unknown or other
  misc_feature (468)..(468): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccacctctcctgcagggccagtcagagtgtagcagcaacttagcctggtaccagcaagaacctggccagccctccaggcctccncatctagtggtnccacgtcccgccgacgggcccacgtaggaactcccgagcctaggttcaggtcggactaggtcgggggtctaacggggactaagggtactttccgacctttccgacaacctaagtccgacgtcaacggtcctaggctagttactaggtaagtttagttttacgtaaagttttnttcttaggttctacggtacgttaagtaactaagtccggtacggttacgggtacccgtttacgggtccgggtttaccgggaaccggtaaacgggggtaaaccgtaaagggggttaaacgtaaaacgttaaaccggaaaacgggtacgttacgggttcggacgttaacgggaccctaaccgttaacgtcctttcgttaacccgtttcgttaacccg

SEQ ID NO: 346445 - DNA, 570 bp, Homo sapiens
  misc_feature: GZ8MTXP01EF6EC.21.65.F10.1.454.CMB.2.raw
  modified_base (195)..(195): a, c, t, g, unknown or other
  misc_feature (195)..(195): n is a, c, g, or t
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
  modified_base (420)..(420): a, c, t, g, unknown or other
  misc_feature (420)..(420): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccacctctcctgcagggccagtcagagtgttagcagcaacttagcctggtaccagcagaaacctggccagccctcccaggcctcctcatctatgggtcncactcccggcagggccacgtggaactcccagccaggttcagtggcagtggggtctaggggacngtagttcacgtctacaccatcagcagctgcagtctagtaagtattttagaaagtttttnttcttgtcgtgtacgtaagtactaagtcgtaggtcggtccgtacgggtaccgtcggaccggaaacgggaacgtaagggttaacggtaaacgttaacgaaacgtacgttggttcggactgcctaacgtacttcgttcgttccttcgtaacg

SEQ ID NO: 346446 - DNA, 726 bp, Homo sapiens
  misc_feature: GZ8MTXP01D1AXU.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgcccaccctctcctgcgacgggccagtcagtagtgtagcagactactacgccgtacgacagacaacgaaccgtggaccacgccctaccgacgtccctcctacgtactcgtaggtcggtcactaccgtcccgacggaccggaccacgtacgacctccgacgtcgtacggtcgacggtcgactggtcggtcgaacgggatgttacttcactcgtacactagtaccgagacgaccgttccgagaaccgttagtttaacccgtaaagggttttaacggttttacgtttttaagggttaaaacgttttttctttaccgggttccggttttaacgtaacggtttaaacgttaaacgttaaacctacggttccgggtacgggttccggtacccggttaccgggttaacccgggtaaccggaaacgggtaaaccgggtaaacgtaaacggggttaaagtaaacgttacggaaacggttacgttcggttccgacgtaaccacccgttaatcgttacttcgttccgttaacgtaaccg

SEQ ID NO: 346447 - DNA, 635 bp, Homo sapiens
  misc_feature: GZ8MTXP01AS6R3.21.65.F10.1.454.CMB.2.raw
  modified_base (195)..(195): a, c, t, g, unknown or other
  misc_feature (195)..(195): n is a, c, g, or t
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (450)..(450): a, c, t, g, unknown or other
  misc_feature (450)..(450): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgtagcagcaacttgcctaggtaccagcaacgaaacctggccacgccctacccgaggtcctccctcactctagtcggtnccacgtcccgcgacgggccacgtggaacctcccgagccgtaggttcacggtcggcgtacgtggggtctagggacngtcgttcactctaccactatcagtcacgtcngctagtcgtagtaagttagttttagtaacgtttttnttcgttgtcggtagtacgtaacgtacgtaagtcggtacggtccggtaccgtcgggtaccgggttaccggaaccggtaacggggtaacgtaaagggttaacggtaaacgttaacggtaaacggtacggttacgggttcgacgtaaccgaccgtaaccgttcgttcgttaccgttccgttccgtccg

SEQ ID NO: 346448 - DNA, 664 bp, Homo sapiens
  misc_feature: GZ8MTXP01B6S39.21.65.F10.1.454.CMB.2.raw
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (470)..(470): a, c, t, g, unknown or other
  misc_feature (470)..(470): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccaccctgtctgtgtctccgaggggagagacgcccacctctcctgcgacgggccagtcaggtagtgttagcagctaacgttcgccgtaggtaccagacaacgaaacctcggaccacgccctccgacggcctcctctatctagtggtcgcacgtccgcgacgggccacgtacgactccacgcgaggttcacggtcggcgacggtcggggtcgtacgggtacngtaggttccactcctcaacngtaccacgctacggtcctcgacgtagttacgtagtaacgtttagtttagttaaagtttnttacgttgtacggttcggtactaacgttaactaagtacgtacggtcggttacccgtcggggttaaccggttacggtaaccgggaaacgggtaaaccggtaaacgggttaacgggtaaaccttaacggaaaacgtgttaacgggttcgacgttcgaacctaacgtcgttccttcggttcctttcggttaaccccg

SEQ ID NO: 346449 - DNA, 544 bp, Homo sapiens
  misc_feature: GZ8MTXP01EWIQ7.21.65.F10.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagtagtgttagcagcaacttagcctggtaccagcagaaactggccagcctcccaggctcctnatctatggtgcatccgccagggccacgtggaactcccagccaggttcagtcgcacgtgggtctaggggacngtagttcactctacaccatcagcagcctgcagtcngtaatntttgaagtttattctgtctgctagtacaatcgagtggccttcggtattcgggaccgaaaggggcctaaaggttagggaaacttacgtaaaacgaacttgggttgaccttggacctaaccgtaattcgttcgttcgtttcgtaaccg

SEQ ID NO: 346450 - DNA, 621 bp, Homo sapiens
  misc_feature: GZ8MTXP01EIDGW.21.65.F10.1.454.CMB.2.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgcccaccctctcctgcgagggccagtcagagtgttagcagctaacttagcctaggaccagcaagaacctggccagccctccagctcctnatctatggtcncactccgacgagggcccacgtcggaactcccgagccgtaggttcaggtcggactacggtcggggtactaggggactaaggtacgtttccactcctacgacctatcagtcagcctgctagttactaggtaaattagttttagaaagttttcttctggttactggtaactaagttaaccaagttccgaggttccggtacccgtgggtaaccgttcggaaccggtaaaggggaaaccgtaagggttaacgaaaacgttacgaaaacgtaacgttcgggttacgttacgtcgactaacctagttccgttgttcccttcgttaacccg

SEQ ID NO: 346451 - DNA, 536 bp, Homo sapiens
  misc_feature: GZ8MTXP01BBJNE.21.65.F10.1.454.CMB.2.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (497)..(497): a, c, t, g, unknown or other
  misc_feature (497)..(497): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttgcctggtaccagcagaacctgcagcctccagctcncatctagtgncatcccgcgagggccacgtggaactcccgagcctaggttcaggtggcagtgggtctagggaccnggtacgttcactcgtacacatcagcacgctgctagtctagtaacttntttagaatttntgtgttctgtactagtacatcgagtcggacctggtacgttcggaccgaagggtaacctaagggngtaaacncgaaaacgtgttcggnggacctgcctaactacgtcgttacgttccgttctaaccg

SEQ ID NO: 346452 - DNA, 664 bp, Homo sapiens
  misc_feature: GZ8MTXP01EIY1F.21.65.F10.1.454.CMB.2.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagagcccacctctcctgcagggccagtcagagtgtagcagcaattagcctaggaccagacaagaaacctggaccagccctaccgaggcctcctcatctagtgggtncacgtccgacgacgggccacgtggaactccagccaggttcacggtggactacggtgggtcgtaagggactaaggtacgttaccaccgttccacctaccagtaccagcacggcctagactagttacgtagtaaagtttacgttttagtaaacgtttttattacgttcggttacttaggtacgtaaacgttaacctaaagttccgtaacgggttcggtaccccgttggggtaaacccggtttccgggaaacccgggaaaggggtaaaccgtaaacgggttaagggtaaaacttaaccggaaaacggtacgttacggttcggacctaacgacctaactagttccgttacgtttcttccgtaacccg

SEQ ID NO: 346453 - DNA, 764 bp, Homo sapiens
  misc_feature: GZ8MTXP01BSMIS.21.65.F10.1.454.CMB.2.raw
  modified_base (287)..(287): a, c, t, g, unknown or other
  misc_feature (287)..(287): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaactgcctggacagcagaactgccagcctccagctctcatctagtggtcncacgtcccggacgacggggcccacgtcggaactcccccgagtacccgtaggttcgacggtcggactacggtggggtcgtaaggggaccaaggtacgttccgaccttcgtaccaaccgtatacccgagacccgacggtaccccgtggaccgttaacggttacgtaaacggttaaaggttttagtttttttaacggtaaaagttttttttccgttttaccgttcgggttttaaccggtacgggttaacgttaaaccggtttaaaccgtaaacgtttcccggtaaacggggtttcccgggtaccccggtttaccgggggtaaacccggggtttacccccggggaaaccggaaaaccggggggtaaaccctaaagggggttaaaggaaaacccgttaaccgaaaaacggtaccgtttgggttcgggttccgtaacggaccctaacgtaccgttaccgttcgtttcccgttaacgtaacccg

SEQ ID NO: 346454 - DNA, 596 bp, Homo sapiens
  misc_feature: GZ8MTXP01DK0VQ.21.65.F10.1.454.CMB.2.raw
  modified_base (321)..(321): a, c, t, g, unknown or other
  misc_feature (321)..(321): n is a, c, g, or t
  modified_base (559)..(559): a, c, t, g, unknown or other
  misc_feature (559)..(559): n is a, c, g, or t
  modified_base (578)..(578): a, c, t, g, unknown or other
  misc_feature (578)..(578): n is a, c, g, or t
  modified_base (589)..(589): a, c, t, g, unknown or other
  misc_feature (589)..(589): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagcccaccctgtctgtgtctccgaggggagagacgcccaccctctcctgcgagggccagtcagtagtgttagcagacctaacttagcctaggtaccagacaacgaaacctggacccacgcccctcccgaggtccctcctactatctagtggtcncgacgtcccggaccgacgggcccacgtacggacctcccgacgccgtaggtcaggcgcgtacggtgggtcgtaagggactggtacgttcccactccaccaccgtatacgacgacacgccgtagctagttactaaggtaactttagttttagtaagttttcttacgtgttacgtagactaagtacatcgagtcgtaccgtggtccgtacggacgtaggaacgtagagaaacagaacgtgnggttgctaacgctaacgtntcttgttcttntaacccg

SEQ ID NO: 346455 - DNA, 746 bp, Homo sapiens
  misc_feature: GZ8MTXP01BPXVT.21.65.F10.1.454.CMB.2.raw
  modified_base (315)..(315): a, c, t, g, unknown or other
  misc_feature (315)..(315): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggagaaatagtgatgacgcagtctccagccaccctgtctgtgtctccgaggggagagacgcccaccctctcctgcagggccagtcagagtgtagcagactaactacgccgtaggaccagcaagaacctggaccacgccctcccgaggcctcctacacttcgtagttcggggtcnccgtaccgtccccggaccggtaacgggggccctaaccggtttacggggaaaccttcccccggaaggtacccgttacgggggtttccgaaacggggttcggggacctacggggttcgggggttaccggtaacgggggaacctaaggggtacgtttaccaacccgttccctaaccacccgtaagtcccaacggacctaacggtccccgtaggtaccttacggttacgttaaggttaaacgtttagtttttaggtaaacttttttcttacgttcgttacgttagacttaaacgttacaacgtcgtaacggtcgcccggttaggtcccgttacgaccgggttaagggaaccgtaaagttacgggaaacttaccggaaaacgtcggttgttcggttctaacggaccctcgtactcgtttcgtaacttccgtaaccg

SEQ ID NO: 346456 - DNA, 656 bp, Homo sapiens
  misc_feature: GZ8MTXP01AOK32.21.65.F10.1.454.CMB.2.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggcctcccagaaagctctggagaaatagtgatgacgcagtctccagcccaccctgtctgtgtcctccgagggganagacgcccacccctctcctgcagggccagtcagagtgtagcagctaatgcctggaccagcagaacctggcccagccctcccgagtcctcctcatctagtggtcncacgtccgccgacgggtccacgtcggaacctcccgagcccgtaggttccaggtcggctacgtgggtctagggacngtactcactcacacgatcacgtcacgctggctagtctagtaattagttttaggaacttttcgttntcgtacttcgaaccttagttaaccaagttccgtaagggttccggtacccggttacgggtacccggttaccgggtaacccgggaaaacggggtaaccgtaaagggggttaaacggaaaacgttaacccgtaaaacgggtaacgttcgggttcgggacccttaaccggtacgaacccgttaacttccggttacctttcccgtttaacctccccgg

SEQ ID NO: 346457 - DNA, 701 bp, Homo sapiens
  misc_feature: GZ8MTXP01BNCW3.21.65.F10.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagctaacttgcctggaccagcaagaacctggccacgccctccgaggcctccnatctatggtcncacgtcccgcgacgggccacgtggaactcccagcctaggtcacggtcggctacggtcgggtcgaaggggaccaaggtcgttaccaccgtctccaacctataccacggtccacggtcccttggacctacggttacctaggtaaacgttagtttttaggaaacgttttttctttaccgttaggttcccggttagtaacccgtaaggttaaacctaaacgtttcccggaacgggttaccgggtaccccggttaaccggggtaacccggtttacccgggggtaaacccgaaaacgggggtaacgtaaacggggttaacggtaaaccgttaccgaaaaacccgggtaagttcgggttacgggttcctaacggcctaacccacgtttcgttcgtttccgttaactccccg

SEQ ID NO: 346458 - DNA, 721 bp, Homo sapiens
  misc_feature: GZ8MTXP01A1NUA.21.65.F10.1.454.CMB.2.raw
  modified_base (194)..(194): a, c, t, g, unknown or other
  misc_feature (194)..(194): n is a, c, g, or t
  modified_base (316)..(316): a, c, t, g, unknown or other
  misc_feature (316)..(316): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctcgaggganagacgcccacctctcctgcgagggccagtcagagtgtagcagctaacttagcctaggtaccagacaagaacctggaccacgcccctaccgacgtcctccgtacacttccgtagtcgggtacnccgtaacgtccccggacggacgggaccctacgttacgggaacctcccggagtcccggtaaggtttccacgggttcggtaccgtacggttcggggacgttaacgggacctaaggtacctttacccgaccttaccgtaccacccgtaagtccacgtccaccggtcctacggctaggttacgttaagtaaacgtttagttttacggttaaatttttcgttcgtggttcctagtaaacgttaacgtaacctaagtcgtaacgggtccggtacccggttacggggtcccgttaaacgggccggtaaacgggggaaccgtaagggttaaacgggaaacttaaacggaaaaccggtgttcggttacgggcctaacgacctaacttaccgtgttacccttcgttaacctcccg

SEQ ID NO: 346459 - DNA, 587 bp, Homo sapiens
  misc_feature: GZ8MTXP01ELFTC.21.65.F10.1.454.CMB.2.raw
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggcctcccagaaagctctggagaaatagtgatgacgcagtctccagccaccctgtctgtgtctccgaggggagagacgccaccctctcctgcgagggccagtcagagtgttagcagcaacttgcctggtaccagacaagaaacctggaccagccctcccaggcctcctcatctatggtncatcccgccaggccaatcggaactcccgagccaggttcagtcggcagtgggtctgggaacagtgtcactcncaccatcagcagcctgactagtctaaggtaattattttagaatttatttcgtgttcagggtactaggtaacaagttcgaaggtccggccgttacgggtacgttcggaacccgaaagggaaccgaaagggtaaggaaactaaccgaaaagtaacgtggttacgggccttaggaacctaccgttaatcgtcgttacttaaccgaacgttttccccg

SEQ ID NO: 346460 - DNA, 608 bp, Homo sapiens
  misc_feature: GZ8MTXP01DBZ8A.21.65.F10.1.454.CMB.2.raw
  modified_base (212)..(212): a, c, t, g, unknown or other
  misc_feature (212)..(212): n is a, c, g, or t
  modified_base (303)..(303): a, c, t, g, unknown or other
  misc_feature (303)..(303): n is a, c, g, or t
  modified_base (390)..(390): a, c, t, g, unknown or other
  misc_feature (390)..(390): n is a, c, g, or t
  modified_base (431)..(431): a, c, t, g, unknown or other
  misc_feature (431)..(431): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccacctctccngcgagggccagtcagagtgtagcagcaacttagcctagaccagcaacgaaacctggaccacgccctcccgagcctcctcatctagtggtcncactcccgcgacgggccacgtaggactccgagcctaggtcaggtcggactaggtgggtcacggggatggtactccacgttcacacgncagcacgctgctagtcgtagtaagttagtttagtaagtttnttcgtgttcgttcgtactaagtactaagtccgtaggtcggtacccgtacgggtaccgggttaccggaaccggtaacgggtaaacggtaagggttaacgaaaacgttacgtaaaacggtcgttaggttcggttactcggacctaacgttctacgttcggttaaccttcgtttaacccg

SEQ ID NO: 346461 - DNA, 579 bp, Homo sapiens
  misc_feature: GZ8MTXP01BP8U3.21.65.F10.1.454.CMB.2.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagctaacttagcctggtaccagcaagaaacctggccagccctccagcctcctcatctatggtcncactcccgccgagggcccacgtggaactcccgagcctaggttcaggtcggctacgtggggtctaggggacnggtacgttccactctcacatcagcacgcctgctagtctagtaagttattttagtaagttttattctgttctgactagtaactatcgacgtcggcccgtcggtaccgttacggaccgtaaaggggtaacctaaggggttacgtaaacttacgaaaaccgtacgttggttcggctcgacctaacctagttcgttacgtccgttcgtaaccg

SEQ ID NO: 346462 - DNA, 748 bp, Homo sapiens
  misc_feature: GZ8MTXP01DCF1W.21.65.F10.1.454.CMB.2.raw
  modified_base (309)..(309): a, c, t, g, unknown or other
  misc_feature (309)..(309): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggagaaatagtgatgacgcagtctccagccaccctgtctgtgtctccgaggggagagacgcccaccctctcctgcgagggccagtcagagtgttagcagacaacttagcctaggtaccagacaacgaacctggaccacgccctaccgagcctcctacatctagtggcncacgtcccgcgacgggccacgtcggaactcccgagccgtaggttcacggtcggacgtcggttcgggtacgtaaggggaactaaggtactttccgaacttcctaccaccctagtccaggacacggtccctagaccgtaacggttacttaagggttaaagttttagtttttaagttaaaacggttttttactttcgttacgtttacggttacgtaccgttaaacgttaaccgttaaagttccggttacgggttccggggttaccccgtaccggggttaaccgggtttacccgggaaacccgggtaaacggggtaaacccggtaaaggggttaaacggtaaaaccgttaaccgtaaaaacgggttcgttacgggttccggttaccgttaacggaccctaaccgttactcgtttaccggttaacctttaaccggttaaccccg

SEQ ID NO: 346463 - DNA, 735 bp, Homo sapiens
  misc_feature: GZ8MTXP01BLVIG.21.65.F10.1.454.CMB.2.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagagcccacctctcctgcagggccagtcagagtgtagcagcaacttgcctaggaccagcaagaacctggccacgcctccgagcctcctcatctagtggtcncacgtcccgacgacgggcccaacgtacggaacctcccgaaggtcccgtaggttaccacggtcggactacggtggggtccgtaaggggaacctggtacgtttaccaaccgttcctaccaaccctatccgacgctacgtcccgtagacctaagttcctaaggtaaagtttacgtttttaggaaagttttttctttacgttcggttacgttacgtaaccgttaaagttaccgtaaacgttccggaaacgggtttcccgggtaccccgtttaccggggtaacccgggtttaccgggaaacccgggtaaaacgggggtaaaccccgtaaaagggggtttacggaaaaaacgttaacccggtaaaaacgggtaccgtttagggttcgggaccttaacgggaccctaacttaacgtttccgttacgttccctttaacgttaaccccg

SEQ ID NO: 346464 - DNA, 759 bp, Homo sapiens
  misc_feature: GZ8MTXP01D9T09.21.65.F10.1.454.CMB.2.raw
  modified_base (164)..(164): a, c, t, g, unknown or other
  misc_feature (164)..(164): n is a, c, g, or t
  modified_base (194)..(194): a, c, t, g, unknown or other
  misc_feature (194)..(194): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtcnccagccacctgtctgtgtctccgagggganagacgcccacctctcctgcgacgggccagtcagtagtgttagcagactaacttgcctaggtaccagacaacgaaacctcggaccacgccctaccgacggcctcctactactctagtcggtcgacctactccccggggggggaccacggggcccacgtacggaacctcccgaacgtcccgtaggttacgacggtcggacgtacggtcggggtacggtaacgggaactaagggtacgttactacctcctaccaccctagtaccgacgacctacgtcccgtagaccgtaagttaccgttaaggttaaacgtttagttttaaggttaacgtttttaagtttccgttacggtttaccggttacgttacgtaaaccgttaaactaaccgttacgtacgggttcggtaccccggttaccggggtaccggttaccgggaaaccgggtaaacgggaaaccggttaaagggttaaacggtaaaacgttaaaccggtaaaacggtaaccgttacgggttacggttacgttaacgaccgtaacctacgttacgttacgttaaccgtttcgtaacccg

SEQ ID NO: 346465 - DNA, 537 bp, Homo sapiens
  misc_feature: GZ8MTXP01E094B.21.65.F10.1.454.CMB.2.raw
  modified_base (363)..(363): a, c, t, g, unknown or other
  misc_feature (363)..(363): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgttctccgaggggagagagcccaccctctcctgcagggccagtcagagtgttagcagcaacttagcctggtaccagcagaaacctggccagccctcccaggctcctcatctatggtgcactccgccaggggccactggaactcccagccaggttcaggtggcacgtggggtctaggggacnggtagttcactctcaccatcagcagcctgcagttcagtaaagttattttgaagttttatttctgttctgctagtacaatcgagtcggccgtcgggtacgtccggacgaaggggaaccaagggttagaaacttacgaaacgacttggttgcgtgcaacntcgttntcttctaacc

SEQ ID NO: 346466 - DNA, 529 bp, Homo sapiens
  misc_feature: GZ8MTXP01ED61A.21.65.F10.1.454.CMB.2.raw
  modified_base (300)..(300): a, c, t, g, unknown or other
  misc_feature (300)..(300): n is a, c, g, or t
  modified_base (511)..(511): a, c, t, g, unknown or other
  misc_feature (511)..(511): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagccctggaccagcagaaacctggccagccctcccgaggcctcctcatctagtggtcncactccgcagggccacgtggactcccagccaggtcagtggcacgtgggtctagggactggtcgttcactctacacctatcagcagcctgctagtctagtaatattttgaaagtttctttcgtgttctgtactaagtacagtcaggttcggacctgggtagtcggaccgaagggaacaagggttgaaattacgaaagacttgcggactgacncgtatcgattccttgtcc

SEQ ID NO: 346467 - DNA, 532 bp, Homo sapiens
  misc_feature: GZ8MTXP01BBIVZ.21.65.F10.1.454.CMB.2.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtagcagctaacttagcctaggtaccagcaagaaacctggccagccctccgaggtcctcctcatctagtggtncatcccgcgacgggccacgtggaactcccgagcctaggttcaggtggcagtgggtctgggacnggtagtcactcacacatcancagctgctagtctagtatagtttagagtttattcgtgtctagctaagtacatcgagtcgccgtcgtacgtcgacgaaggaactaggttagaaacttacgaaacgtacttggttggacctgacctaactatcttacgtccttgtaacc

SEQ ID NO: 346468 - DNA, 672 bp, Homo sapiens
  misc_feature: GZ8MTXP01DMWBZ.21.65.F10.1.454.CMB.2.raw
  modified_base (296)..(296): a, c, t, g, unknown or other
  misc_feature (296)..(296): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgttagcagcaacttagcctaggtaccagcagaaacctggccagcctccaggctcctcatctatggtncactccgccgaagggcccacgtcggaactccccgagcccagggttccacggtcggactacggttcggggtcgtagggggaaccaagggtacgtttccaaccttcctcccaaccatccaagcgagccctggacctagtctagtaaagttattttagaaagttttcttacttgttcgttggtcctaaagtactaaagtccgtaaggttcggtcccgttacgggtaccggtttccgggaacccggtaaagggggtaacccgtaaaggggttaacggggaaaaacttccgaaaaaaccgggtaaccgttgggttacgggacccttaagggaccctaacccggtaacttcccgttagtttccccgtttaacgttaaccccg

SEQ ID NO: 346469 - DNA, 719 bp, Homo sapiens
  misc_feature: GZ8MTXP01AWCAB.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccacctctcctgcagggccagtcaggagtgtagcagactaacttgcctggtaccagcaacgaacccgtggacccacgccctacccgaggtcccctcgtacatctatcggtcacctacgtcccgacgacgggcctacgtcggaactcccgagccgtaggtcacggtcggactacggtcggggtacgtaaggggacctaaggtaccgtttaccaaccgtttcccacctaaccgatttacccggaacgtcccgtaaccggtcccgtcggtaccgtacgggttacgttaaggttaaaacggttttacgtttttaacggttaaaagtttttacttttccgttaggttacccgttggtaaaccgttaacgttaactaaacgttcgtacgggttaccggtcccggttaacgggtacccggttaccgggaacccgtaaacgggggaacctaagggttaaggtaaacaaccgtaaacggtacgttgttacgcgttcgacctaacctgttcttacgtccttcgtaacc

SEQ ID NO: 346470 - DNA, 616 bp, Homo sapiens
  misc_feature: GZ8MTXP01CX8AL.21.65.F10.1.454.CMB.2.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtancagcaattgcctggaccagcagaaccnggccagcctccagctccnatcatgncatccgcagggccagtggaactccagcctaggtcagtggcagtgggtcngggacnggattcactcncacntcagcagctgctagtctaggtaagttattttaggtaattttatttcgttgttcgtcgtactaacgtacaaagttccgtaaggtcgggtcccgttacgggtaccggtttacccgggaaccggtaaacgggggtaacccgtaaagggggttacggtaaaaacttacccggtaaaaaacccgggtagttaacgggttcggaaccgttaacgggaaccctaaccccgtaattcccgttaccggtttcccttttaacgtaaccccg

SEQ ID NO: 346471 - DNA, 647 bp, Homo sapiens
  misc_feature: GZ8MTXP01ANFFO.21.65.F10.1.454.CMB.2.raw
  modified_base (195)..(195): a, c, t, g, unknown or other
  misc_feature (195)..(195): n is a, c, g, or t
  modified_base (329)..(329): a, c, t, g, unknown or other
  misc_feature (329)..(329): n is a, c, g, or t
  modified_base (511)..(511): a, c, t, g, unknown or other
  misc_feature (511)..(511): n is a, c, g, or t
  modified_base (603)..(603): a, c, t, g, unknown or other
  misc_feature (603)..(603): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagacgcccaccctctcctgcgagggccagtcagagtgttagcagactaacttagcctaggtacccagacaacggaaacccgtcgggaccccacggcccctacccgaggtccctccgtcattcgtattggggtcncctacgtcccgaccgacgggccacgtacggaacctcccgagccgtaggttcacggtcggcgtacggtcggggtcgtagggacctggtacgttccacttcctaccaaccgtataccgaacggcctaacgtcccgttagccgttaagttcgtaagtaaagtttacttttaggttaaacgttttnttcgttgtctaggtactaagtactaactcggtagtccggtaccgtcggtacgttccgacggacggtaacgaaggttagaaattcgaaaacgngttacgttcggctaaggacctcgattccttacgttcttcgtccc

SEQ ID NO: 346472 - DNA, 734 bp, Homo sapiens
  misc_feature: GZ8MTXP01EM4QS.21.65.F10.1.454.CMB.2.raw
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (712)..(712): a, c, t, g, unknown or other
  misc_feature (712)..(712): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagacaacttagcctaggaccagacagaaacctggaccacgccctccgaggtcctcctacatctagtggtcncacgtcccgacgacgggccaaccgtggaacctccccgagccgtaggttccaggtcggcgtacggtggggtaccgtagggaactcggtacgtttaccaccttcctaccaacccctagttccgaacgtccgaacgtcccgttaggacctaaggtttacgtaaaggttaaagttttcgtttttaaagggttaaacgtttttttctttaccgttgtttaccggttacggtaacttaaacggtttaaaccctaaagttccggtaacgggttccggggttaaaccccgttccgggggtaaccgggtttcccgggaaccccggttaaagggggaaaccccgtttaagggaaacggtaaacttaaaccggaaacggtaacgttggttacgccgttaagaccctaacccggttnttacgttcttcttaacgtcccg

SEQ ID NO: 346473 - DNA, 715 bp, Homo sapiens
  misc_feature: GZ8MTXP01CFUY6.21.65.F10.1.454.CMB.2.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgtancagcaacttgcctggtaccagcaagaaacctggccagccctccaggctccncatcagtggtncacgtcccgacgagggccacgtaggaactccccgagcccgtaggttcaacggtcggactacggtgggggtccgtaagggggaacctaagggacgttttccaaccttcaccaacctatccgagccgagtccctgcgtaagtaccgttaaggtaaagtttatttttacgggttaaatttttcgtttcgtcggtttcggttaggtacctaaagttaaaccgtaaagttcccggtaagggttcggggttaccccgttacggggtaacccggggtttacccggaaccgggtaaacgggggtaaaacccgtaaaagggggtttacgggaaaaccgttaaaccgaaaaacccgggtggttagggttacggttacccgtggaacccctaacgttacgttcggttactttaacccgtttcgtaaccccg

SEQ ID NO: 346474 - DNA, 618 bp, Homo sapiens
  misc_feature: GZ8MTXP01BTYQT.21.65.F10.1.454.CMB.2.raw
  modified_base (304)..(304): a, c, t, g, unknown or other
  misc_feature (304)..(304): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggaagaaatagtgatgacgcagtctccagccaccctgtctgtgtctccgaggggagagacgcccaccctctcctgcagggccagtcagtagtgtagcagctaacttgcctggaccagcaagaacctgccagccctccgagtctccgtactatctagtcggtacnctacgtcccgacgacgggccacgtggaactcccgagccaggttccaggtcgactacgttgggacctagggactggtacgttccactcgtacaccatccagcagtcctgacgtagtacgtagtaacgttagtttagtaattttcttacgttcttcgtagtacgtaacgtaactaacgtcgtacggtcggtaccctacgggtacggttaccgaccggaacgggtaacgtaacgggttacgaaacttaccggtaaaacgtgttacgttcggacgtaacgtacccaacgttacgtcgttcgttaaccgttctaacccg

SEQ ID NO: 346475 - DNA, 642 bp, Homo sapiens
  misc_feature: GZ8MTXP01A2ICV.21.65.F10.1.454.CMB.2.raw
  modified_base (195)..(195): a, c, t, g, unknown or other
  misc_feature (195)..(195): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (486)..(486): a, c, t, g, unknown or other
  misc_feature (486)..(486): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcgagggccagtcaggtagtgttagcagactaacgttacgccgtacggaaccaggacgaaacgaaaccgtcggaccacggtcccctaccgagtcctacctcattctagtcgcncacgtcccgacgacggccacgtacgaactcccgagcgtaggttcacggtcggactacgggtggtcgaagggtacnggtacgttacacctctaccaccgtatccgataccgacgccgtgaccgtagttacctagtaaagttttgtttaaggttaacttttnttacgtgtacgtaggacttaaagtactaagtccgtagggtcgtacccgttcggtacccgggtcgaaaccggtgggtaaccggtaaggttacgaaacttcgaaaacggggtcttggttcgctaactcgtaacttgtcttcgttaacttcgtaacccg

SEQ ID NO: 346476 - DNA, 612 bp, Homo sapiens
  misc_feature: GZ8MTXP01AC1BU.21.65.F10.1.454.CMB.2.raw
  modified_base (195)..(195): a, c, t, g, unknown or other
  misc_feature (195)..(195): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (593)..(593): a, c, t, g, unknown or other
  misc_feature (593)..(593): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgtagcagcaacttagcctggaccagcaagaaccctggccagccctccgaggcctcctnatctagtgggtcncactccgaccgagggccacgtggaactcccgagcctaggttcacggtcggactaggtggggtctaggggacctaaggtacgtttcccaacttccgaccaactagtaccaagccacggtcccgttagaccgtaggtcgtaaggtaaagtttagtttttaaggaagtttttacttcgttagtcgttagactagtacaagtcgaggtcgccgtgggtccgttaccggacgaacgggtaaccaaggggttagaaaacgttacgaaaacggtacttgggcgttactcggcaaccgtntacgttgtccttctaaccg

SEQ ID NO: 346477 - DNA, 528 bp, Homo sapiens
  misc_feature: GZ8MTXP01AZK1I.21.65.F10.1.454.CMB.2.raw
  modified_base (160)..(160): a, c, t, g, unknown or other
  misc_feature (160)..(160): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (393)..(393): a, c, t, g, unknown or other
  misc_feature (393)..(393): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggcctcccagaaagctctggagaaatagtgatgacgnagtctccagccaccctgtctgtgtctccgagggganagacgccaccctntcctgcagggccagtcagtagtgtagcagctaacttagcctaggtaccagcaagaaacctggaccagcctccaggctccnatctatggncntccgcaggccatgaactccagccaggtcagtccggctacgtgggtcctgggaacaggnttccaactctaccacagtccagctagcctgcagtntagtagtattagtagttattatgttntgtatatactanagtgtcgcgtacgtacgtcgacgacggaacgaagtaagaagtaacgaacgaacgtagttacgcgacgaacactaactctcgttacttcgttcgtccg

SEQ ID NO: 346478 - DNA, 646 bp, Homo sapiens
  misc_feature: GZ8MTXP01BI46A.21.65.F10.1.454.CMB.2.raw
  modified_base (193)..(193): a, c, t, g, unknown or other
  misc_feature (193)..(193): n is a, c, g, or t
  modified_base (316)..(316): a, c, t, g, unknown or other
  misc_feature (316)..(316): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
  modified_base (631)..(631): a, c, t, g, unknown or other
  misc_feature (631)..(631): n is a, c, g, or t
  modified_base (644)..(644): a, c, t, g, unknown or other
  misc_feature (644)..(644): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctcgagggganagagcccaccgtctcctgcgagggccagtcagtagtgttagcagctaacttgccgtaggtaccagacaacgaacctggaccacgtccctcccgaaggtcctccgtctattccgtatcggggtnaccgacgtccccggacgaccggggccctaacggtacggaaacctccccgagtcccgtaggtttccgaacgggttccggactacgggttcggggtaccgtaagggggaccaagttacgttccacctctaccaacgatcccgaagccaacggtcctaacggctagttaccgtaaggtaaatttgggtttttaanaagtttttntcgttgtcctagtaccgtattacgaaattcgcggtcggaccgttcggacggttcgaaccgaagggaacctaaaggttgaaacncgaaacgngttcggttgcctgactaaccgtntcgttctccttcncg

SEQ ID NO: 346479 - DNA, 674 bp, Homo sapiens
  misc_feature: GZ8MTXP01EO7EI.21.65.F10.1.454.CMB.2.raw
  modified_base (317)..(317): a, c, t, g, unknown or other
  misc_feature (317)..(317): n is a, c, g, or t
  modified_base (398)..(398): a, c, t, g, unknown or other
  misc_feature (398)..(398): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaagctctggagaaatagtgatgacgcagtctccagccaccctgtctgtgtctccgaggggagagacgccacccctctcctggcagggccagtcagtagtgttagcagactaacttgcctgggaccagcaacgaaaccctggacccacgccctcccgaggtcctacctcacttctagtcgggtcnccgtactcccggaccgacgggccaacgtaggaactcccagccgtaggtcacggtcggctacggtggggtccgtagggaacnggtacgttaccaccttcctaccaccgataccgagcacggcctggactaggttactaggttaaattgtttagttaaagttttcttagttcgttacgtcggtacttaacgtactaacgtcggtaaggttccgggttacccgtccgggttaccggttaccgggaaccggaaaggggtaacccggtaaagggtttaggaaaacttaccgaaaacggtacggttacggttggacccgtaagaccctaaccgtaagttcgttccttaacgttcgtaaccccg

SEQ ID NO: 346480 - DNA, 709 bp, Homo sapiens
  misc_feature: GZ8MTXP01DJW37.21.65.F10.1.454.CMB.2.raw
  modified_base (283)..(283): a, c, t, g, unknown or other
  misc_feature (283)..(283): n is a, c, g, or t
  modified_base (342)..(342): a, c, t, g, unknown or other
  misc_feature (342)..(342): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagacgccaccctctcctgcgagggccagtcagagtgttagcagactaacgttagccgtggtaccagcaacgaaccgtggcccagcccncccgaggcctcctcatctagtcggtgctacgtccccgccgagggccctacgtcggaacncccgagacctaggtcaggtccgctacggtggtacgtggaacagtcgtctacgctacacatcacgcgacgtccgtgactagttacgtaaggaacgtttatttaggtaaacgttttcgttcgttacgttcgttcggggtaaccttaaagttaaccgtaaacgttcgtaacggtcccggttaccggttaccgggtaacccgtttaccggggaacccgtaaacgggggtacccgttaaaggggaacgttaaaaccggtaaccgaaaacggttacccgggttacgggttaaccggttccgttaacggtaacccctaacggttctttacccgttacgggtttaccctttaaccgttccgttttaacccccggg

SEQ ID NO: 346481 - DNA, 558 bp, Homo sapiens
  misc_feature: GZ8MTXP01AKTNV.21.65.F10.1.454.CMB.2.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccaccctctcctgcagggccagtcagagtgttagcagcaacttagcctggaccagcagaacctggccagcctccagctcnatcatggncagtccgcagggccacgtggaactcccgagtccaggttcacgtggctacggtggtctaagggactggacgttcactcncaccatccagcagcctgctagtctagtaattatttggaaacttttnttacgtgtcgtacgtgtaacgtactactcgacggtccgtaccgtcggtacgtaccggaccggaacgggaacgtaagggttacgtaaacttacgaaacgtacgcggttcgcgtaacgacctaacgtactcgttacgttccgttcgtc

SEQ ID NO: 346482 - DNA, 601 bp, Homo sapiens
  misc_feature: GZ8MTXP01BY0LG.21.65.F10.1.454.CMB.2.raw
  modified_base (306)..(306): a, c, t, g, unknown or other
  misc_feature (306)..(306): n is a, c, g, or t
  modified_base (439)..(439): a, c, t, g, unknown or other
  misc_feature (439)..(439): n is a, c, g, or t
  modified_base (454)..(454): a, c, t, g, unknown or other
  misc_feature (454)..(454): n is a, c, g, or t
  modified_base (457)..(457): a, c, t, g, unknown or other
  misc_feature (457)..(457): n is a, c, g, or t
  modified_base (572)..(572): a, c, t, g, unknown or other
  misc_feature (572)..(572): n is a, c, g, or t
  modified_base (580)..(580): a, c, t, g, unknown or other
  misc_feature (580)..(580): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagtagtgttagcagcaacttgcctggtaccagcaacgaaaccgtggccacgccctccgaggtcctcctcatcgtagtggtcncacgtcccgcgaggggccaacgtgaacctccccgagtccctaggttcacggtcggactacggtggggtctaaggggactaaggtcgttccacttcccacaaccagtccagcacgctgctagtctagtaagttnttttagaaagttttnttntcggttctacgtaagtatactaacgcgtacggttcggtacccgtgggtaccgttcgggaccgtaaaggggaacccaagggttacgaaacttcgaaaacgtgttacgcggacgtcnctaacctntccgttctccttaacgtcccg

SEQ ID NO: 346483 - DNA, 612 bp, Homo sapiens
  misc_feature: GZ8MTXP01EW410.21.65.F10.1.454.CMB.2.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccacctgtctgtgtctccgaggggagagagccactctctcctgcagggccagtcagagtgtancagctaatgcctggacagnaagaacctggcagccctccgagctctcatctagtggtnacactccgacgagggtccacgtaggaacctcccgagcccgtaggtcaggtcggactacgtggggtcaaggggacaaggtacgtccactcactaccatcacgctacggcctgactagttctagtaaagttattttaggtaattttacttcgttgttaccggttcgtaacgtaacgtaactagttaccgtggttaccgggtcccgttaggggtccgttaaccgggacggtaaacgggaaccgtaaaggggttaagaaacgttacgaaaaacgtgttacggttcggacgtaacggcctaactacgtcgttactttcgttctaacccg

SEQ ID NO: 346484 - DNA, 756 bp, Homo sapiens
  misc_feature: GZ8MTXP01B6BD2.21.65.F10.1.454.CMB.2.raw
  modified_base (292)..(292): a, c, t, g, unknown or other
  misc_feature (292)..(292): n is a, c, g, or t
  modified_base (406)..(406): a, c, t, g, unknown or other
  misc_feature (406)..(406): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggcctcccagaaagctctggagaaatagtgatgacgcagtctccagccaccctgtctgtgtctccgaggggagagacgccccaccctctcctgccgagggccagtcagagttgtagcagctaattgcctgtaccagcaagaacctgccacgccctccacggctccctnattctatggtcgacacgtccccgaccgacggggccctaacgtcggaacctccccgagtcccgtaggttccgaacgggtcggccgtaacgttcgggggttccgtaaggggaaccngggttaccgttaccaccttcctacctaaccgactaccgacgcaacggcctgacctagttccgtagttaaagttacgttttagttaattttagtttccgttggttcttacgtacttaaggtaccttaagttccgtacgggttccggtacccggttacggggttaacccgtttcccgggaaacccgggtaaaccgggggtaaccgtaaaacgggggtttaacgggaaaaacccgttaaaccgggtaaaaacccggttaaacgttcgggggttaaccgggttaccgtttaaccgggtaaccctaacgttaacggttaccccggttcggttttaaccttaacccggtttccccg

SEQ ID NO: 346485 - DNA, 733 bp, Homo sapiens
  misc_feature: GZ8MTXP01AUZF2.21.65.F10.1.454.CMB.2.raw
  modified_base (195)..(195): a, c, t, g, unknown or other
  misc_feature (195)..(195): n is a, c, g, or t
  modified_base (315)..(315): a, c, t, g, unknown or other
  misc_feature (315)..(315): n is a, c, g, or t
  modified_base (699)..(699): a, c, t, g, unknown or other
  misc_feature (699)..(699): n is a, c, g, or t
  modified_base (706)..(706): a, c, t, g, unknown or other
  misc_feature (706)..(706): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccaccctctcctgcgagggccagtcagaggtgttagcagcaacgttgccgtaggtaccagacaacgaaacctggaccacgcccctcccgacggcctcctacattctagtcgggtnaccacgtcccggccgacggggccctacgtacggtaacctccccgacgtaccgtagggtttcaccgggtcggaccgtacgggtcggggtacggttacggggaaaccgtaacggttagttacccgtacctcccgtaccaacccgacttcgaaccgcctacggtcccgttacgaccgttaagtccgttaagggttaacgttttagtttttaaggttaagtttttacgtttacgttcgtttacggtggtacttaaaggtacccgttaaagttccgtaaggttccgggtaccccgttacgggggtccggttaccggaaaccggtaacggggaaccggtaaagggttaacggtaaacttacggaaaacccgttgttacggttggttacgngtaaccncgtactacttcggttccttaacgtccc

SEQ ID NO: 346486 - DNA, 733 bp, Homo sapiens
  misc_feature: GZ8MTXP01B699G.21.65.F10.1.454.CMB.2.raw
  modified_base (195)..(195): a, c, t, g, unknown or other
  misc_feature (195)..(195): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagacgcccaccctctcctgcgagggccagtcagagtgttagcagactaacgttgccgtaggtaccngacacgaaacctcggccacgcccncccgaggcctcctnactctagtggtcaccacgtccccgaccgacggggaccctacgtcggaactccccgagtcccgtaggttcgacggtccggcgtacggttggggtccgtagggaaaccgttaggtaacgttacctaccgttcccgtacccaaccgtacgtcgaacggtccgtaccgtccgttacgggacgttacggttacggttaaagtaaaggtttttacgttttaacggtttaagtttttaccttgttcttacgttcggggtacttaacggttaacctaagttacgtacgggttccggttccgtaccgggggttaccggttccggaacgggtaaacggggtacggtaaaacgggtgttaaacgtacgaaacggtacttcgggttacggttcgttacccgcctaacgtcttcccgttggttcccttaacgttccgtttcccccgg

SEQ ID NO: 346487 - DNA, 636 bp, Homo sapiens
  misc_feature: GZ8MTXP01AS1CX.21.65.F10.1.454.CMB.2.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
tcagtcgtcgctcgcacgaccggtgctcgatttagctacgctctaaggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtagttagcagctaacttagcctggtaccagctagaaaccgtggcccagccctccaggtcctcctanacttacctatgggtcnctactcccggccgtagggcctaacgtgggaacctcccgagcccgtaagtccgaagttcggctacgtcggggtcacggggacaagtcgttacacgttcacaccntcagctcgcgtcgacncgtacgtagtagttagtttagttagtttaagtttaccttgttccgttagtacgtacgtaacctaagtacgtaacgtcggtaccgtcgggtcggtaccggtaccggaacgggaacccggtaaggttacggaaacgttaaccgaaaccgtaacgttcgttacggacgttcggaccgaaccgtactcgttaccgttccgttccgtttcccg

SEQ ID NO: 346488 - DNA, 505 bp, Homo sapiens
  misc_feature: GZ8MTXP02JOACA.21.65.F10.1.454.CMB.2.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctcatctatggtncatccgccagggcccagtggaactcccagccaggttcagtggcacgtgggtctgggacnggagttcactctcacatcagcagcctgcagtctgaagtattttgaagtttatttctgtctgctagtacaatcagtggcctcggacgttcggaccgaaggaccgaaggtggaaaactacgaaacgactgtggctgcaccgatctcgtcttcac

SEQ ID NO: 346489 - DNA, 523 bp, Homo sapiens
  misc_feature: GZ8MTXP02IYHV4.21.65.F10.1.454.CMB.2.raw
  modified_base (292)..(292): a, c, t, g, unknown or other
  misc_feature (292)..(292): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctccaggctcctcatctatggtncatccgcagggccatggaactcccagccaggttcagtggcacgtgggtcnggggacngagttcactcncacatcagcagccctgccngtctagaaagtnttttagaagtttatttctgttctgtcagttacaatcgagtggcctcggacgttcggaccaagggaccgaagggtacgaaaactacgaaaacgtacgtagtggactgacaaccgtatcttacgtacttactac

SEQ ID NO: 346490 - DNA, 505 bp, Homo sapiens
  misc_feature: GZ8MTXP02GOVGX.21.65.F10.1.454.CMB.2.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctcatctatggtncatcccgcagggccactggaactcccagccaggttcagtggcacgtggggtctggggacngagttcactctcaccatcagcagcctgcagtctgaagtattttgaagtttattctgtctgcagtacaatcagtggcctcggacgttcggaccgtaagggaccaagggtagaaactacgaaaacgactggtgctgcacgatctagtctctac

SEQ ID NO: 346491 - DNA, 507 bp, Homo sapiens
  misc_feature: GZ8MTXP02HK7K2.21.65.F10.1.454.CMB.2.raw
  modified_base (193)..(193): a, c, t, g, unknown or other
  misc_feature (193)..(193): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaaggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctcccaggcctcctcatctatggtgcatccgccagggccacgtggaactcccagccaggttcagtggcacgtggggtctggggacnggagtttcactctcaccatcagcagcctgcagtctgaagtattttgaagtttatttctgtctgctagtacaatcagtgcctcggacgttcggaccaagggaccaaggtggaaactcgaaacgatcgtaggactgcaccatctcgtacttcac

SEQ ID NO: 346492 - DNA, 500 bp, Homo sapiens
  misc_feature: GZ8MTXP02I37XE.21.65.F10.1.454.CMB.2.raw
  modified_base (193)..(193): a, c, t, g, unknown or other
  misc_feature (193)..(193): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagtcgtcgctcgcacgaccggtgctcgatttagctacgctctaaggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctcccaggcctcctcatctatggtncatccgccagggccactggaatcccagccaggttcagtgcactgggtctggggacngagttcactctcacatcagcagcctgcagtctgaatntttgaagtttatttctgttctgtcagtacaatcagtggcagtcggacgttcggccgaaagggaccaagggtaggaaatacgaaacgaactggtggctgcaccatcctgtcttc

SEQ ID NO: 346493 - DNA, 496 bp, Homo sapiens
  misc_feature: GZ8MTXP02J4KM2.21.65.F10.1.454.CMB.2.raw
  modified_base (194)..(194): a, c, t, g, unknown or other
  misc_feature (194)..(194): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctccaggctcctcatctatggtgcatccgccagggccagtggaactcccagccaggttcagtggcacgtggtcngggacngattcactctcacatcagcagcctgcagtctagaagtatttagtagtttattctgtctgctagtacatcagtcgctggactcgaccgaaggtaccaaggtagaaactcaaacgtacacgttggctgacacactcgtctcttctacg

SEQ ID NO: 346494 - DNA, 499 bp, Homo sapiens
  misc_feature: GZ8MTXP02FYAW1.21.65.F10.1.454.CMB.2.raw
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcacgtgggtctggggacngagttcactctcaccatcagcagcctgcagtcngaagtattttgaagtttattctgtctgcagtacaatcagtggcctcggacgttcgccgaagggaccgaaaggtcggaaaatcaaacgaactgtgctgcaccatctgtcttctac

SEQ ID NO: 346495 - DNA, 515 bp, Homo sapiens
  misc_feature: GZ8MTXP02JSG7Z.21.65.F10.1.454.CMB.2.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctcccaggctcctcatctatggtgcatccgccagggccatggaactcccagccaggttcagtggcactgggtctgggacngngttcactctcaccatcagcagcctgcagtctgaagtattttgagtttattctgtctgtcagttacaatcaggtcggacctcgggacgttcggaccgaaaggggtacccaaagggtggaaaactcgaaaacgaacgtgtaggctgcaacatcctgtctttacac

SEQ ID NO: 346496 - DNA, 513 bp, Homo sapiens
  misc_feature: GZ8MTXP02JA9JM.21.65.F10.1.454.CMB.2.raw
  modified_base (360)..(360): a, c, t, g, unknown or other
  misc_feature (360)..(360): n is a, c, g, or t
  modified_base (411)..(411): a, c, t, g, unknown or other
  misc_feature (411)..(411): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggcctcctcatctatggtgcatcccgccagggcccacgtggaactccccagcccaggttcagtggcacgtggggtctggggacnggagttcactctcacatcagcagcctgcagtctgaagtattttgaagtttnttctgtctgcagtacaatcagtcggcctcggacgttcggacgaagggaccaagggtaggaaactacgaaaacgactgtaggctgccacatctgtcttactac

SEQ ID NO: 346497 - DNA, 513 bp, Homo sapiens
  misc_feature: GZ8MTXP02HXFUJ.21.65.F10.1.454.CMB.2.raw
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctccaggctcctcatcatggtncatccgcagggccagtggaactcccagccaggttcagtggcacgtgggctggggacngtagttcactctacacatcagcagcctgcagtctgaagttatttgaagtttattctgtctgctagtacaatcagtcgacctggaacgttcggaccgaaagggaccaagggtggaaaactcgaaacggtaactggtcggactaagcaactatccttgtctttacac

SEQ ID NO: 346498 - DNA, 786 bp, Homo sapiens
  misc_feature: GZ8MTXP02HOXH1.21.65.F10.1.454.CMB.2.raw
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggganagcgccacctctcngcgacggcagtcagngttgtancagactaagtcgcgtacgacagacaaacgaaccgtcgaccacgcccctaccggagtccctccactacttactagtgggtcactaccgtcccgaccggacgggacccctacggtaaggtaacccacccgacgtacccggtacggttacgacggggtccgaacctacggggtttccggggttacgggtaaccggggaaacgtacggggtttaccggtttaccctaaacccgtttcccgaacccctaacctacgttacccgaacgtaccgaacccggttcccgtacgggaacttacggtttccgtaaaggggtaaaacttttttaggttttaaacgggtttaaagtttttacttttcgttacggttacttccgtaagttaacgtaaaccttaagtcgtacgggtccggtacggttaccggttacggtcccggaaacggtaaaccggggaacgttaaggggtaaaacgtaaaccgtaaacgaaaaccgttacggttaaggtaccggttctaaccggaacctaaacgttacttacggtttccgttacctttactaccccg

SEQ ID NO: 346499 - DNA, 529 bp, Homo sapiens
  misc_feature: GZ8MTXP02IFF1D.21.65.F10.1.454.CMB.2.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (408)..(408): a, c, t, g, unknown or other
  misc_feature (408)..(408): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccacctctcctgcagggccagtcagagtgttagcagcaacttagcctggtaccagcagaaacctggccagccctcccaggcctcctcatctatggtncatcccgccagggcccagtggaactcccagccaggttcagtcggcacgtgggtctggggacngtgttcactctcaccatcagcagcctgcagtctagaagtatttgaagtttnttctgttctgtactagtacaatcgagtcggccttggacgttcggacgaagggtaccgaagggttaggaaaactacgaaaacgtacgtagtggacgtgacaacctctactcgtcttactacg

SEQ ID NO: 346500 - DNA, 552 bp, Homo sapiens
  misc_feature: GZ8MTXP02JLN0S.21.65.F10.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcagaaacctggccagcctcccaggctcctcatctatggtncatccgccagggcccagtggaactccccagccaggttcagtggcacgtggggtctggggacnggtacgttcactctcacatcagcagcctgcagtctaggaaagttattttagaagttttactttctgttctgctagtacaatcaggtcgccgtgggtaccgttccgggaccaaaggggaccgtaaagggtacggaaaactacgaaaacgacgtggtacgggctaacggacaacctattcgtcgttccttactaccg

SEQ ID NO: 346501 - DNA, 493 bp, Homo sapiens
  misc_feature: GZ8MTXP02GG23K.21.65.F10.1.454.CMB.2.raw
  modified_base (352)..(352): a, c, t, g, unknown or other
  misc_feature (352)..(352): n is a, c, g, or t
  modified_base (473)..(473): a, c, t, g, unknown or other
  misc_feature (473)..(473): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctccaggctcctcatctatggtgcatccgccagggccatggaactccagccaggttcagtcggcacgtgggtctgggacagngttcactctcaccatcagcagcctgcagtctagaagtattttgaattttattctgtctgctagtacaatcagtggcctggacgttcgccgaaggaccaaggtgaaatcaaagactgtcggntgcacatctgtctcattccc

SEQ ID NO: 346502 - DNA, 516 bp, Homo sapiens
  misc_feature: GZ8MTXP02IFSUQ.21.65.F10.1.454.CMB.2.raw
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctccaggctcctcatctatggtncatccgcagggccactggaatcccagccaggttcagtgcacgtgggtctgggacnggagtttcaccttcctcaccatccagcagcctgcagtctagagtatttgaaatttnttntntntgactagtanatgagtcgctcggacgttcgacgaaggacgaaggtagaaactaacgaaacgtacgtggtcgacgtaagacaacgtactcgttcgttacttactac

SEQ ID NO: 346503 - DNA, 507 bp, Homo sapiens
  misc_feature: GZ8MTXP02ITE03.21.65.F10.1.454.CMB.2.raw
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctcatctatggtncatccgccagggccatggaactcccagccaggttcagtgcactgggtctgggacngattcactctcacatcagcagcctgcagtctagaagtattttgaagtttatttctgttctgtctagtacaatcagtcggcctcggacgttcggaccaaggggtaccaagggtagaaactcgaaaacgtacgtgtaggactgccacactctgtcttcac

SEQ ID NO: 346504 - DNA, 503 bp, Homo sapiens
  misc_feature: GZ8MTXP02HNL0X.21.65.F10.1.454.CMB.2.raw
  modified_base (352)..(352): a, c, t, g, unknown or other
  misc_feature (352)..(352): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccagggctcctcatctatggtgcatccgccagggccactggaatcccagccaggttcagtggcacgtgggtctgggacngagttcactctcaccatcagcagcctgcagtctgaagtatttgaatttattctgtctgcagtacaatcagtggctcggacgttcggacgaagggaccaagggtaggaaactacgaaacgaacgtagtggactgcacactactctcttctac

SEQ ID NO: 346505 - DNA, 544 bp, Homo sapiens
  misc_feature: GZ8MTXP02GT4YL.21.65.F10.1.454.CMB.2.raw
  modified_base (363)..(363): a, c, t, g, unknown or other
  misc_feature (363)..(363): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccacccctctcctgcagggccagtcagagtgttagcagcaacttagcctggtaccagcagaacctggccagccctccaggcctcctcatctatggtgcactcccgcgacgggccacgtggaactcccgagccaggttcaggtgctacgtggggtctggggacnggacgttcactctcacatcagcacgcctgcagtctagtaagttatttagtaagtttattcgtgttctgactagtacatcgaggtcggtccgtcggtacgttcggacgaaacgggaccgaaagggtgaaaacgtacgaaaacggacgtggcggtactgccaactactcgtcgtacttctacg

SEQ ID NO: 346506 - DNA, 557 bp, Homo sapiens
  misc_feature: GZ8MTXP02IF0AI.21.65.F10.1.454.CMB.2.raw
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccaggggagagagccacctctcctgcagggccagtcagagtgttagcagcaacttgcctggtaccagcagaaacctggccagcctcccaggctcctcatctatggtncatccgcagggccactggaactcccagccaggttcagtggcactggggtctgggacnggngttcacttctcacatcagcacgctgcagtctagaagtattttagaagtttatttctggttctgtactagtaactaaattccgaaggttcggccttacgggtacgtttcgggaccgtaaaacggggaccaaaaggggttaggaaaacttaccgaaaaacgtaacgtgttagggaccttaaggacaacctagtcttcgttcttactac

SEQ ID NO: 346507 - DNA, 531 bp, Homo sapiens
  misc_feature: GZ8MTXP02IQDFG.21.65.F10.1.454.CMB.2.raw
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggcctcctcatctatggtncatcccgcagggccacgtggaactcccagccaggttcagtgcacgtgggtctgggacnggagttcactctcacatcagcagcctgcagtctagtaagtattttagaagtttatttctgttctgtcagtacaatcagtcggctggaagttcggacgaagggaccaagggtaggaaaactacgaaaacgtacgtagtcggactaaggaccaacctattccttacgttccttactaccg

SEQ ID NO: 346508 - DNA, 523 bp, Homo sapiens
  misc_feature: GZ8MTXP02G03FR.21.65.F10.1.454.CMB.2.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaaggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggcctcctcatctatggtncatcccgccagggccactggaactcccagccaggttcagtggcacgtgggtctgggacngagttcactctcaccatcagcagcctgcagtctgaagtatttgagtttattctgttctgctagtacaatcgagtcggctcggacgttcggaccgtaaagggaccaaagggtacgaaaactacgaaaacggaacgtgtacggctaaggccacctatcgtcgtcttactacg

SEQ ID NO: 346509 - DNA, 521 bp, Homo sapiens
  misc_feature: GZ8MTXP02ILGM5.21.65.F10.1.454.CMB.2.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (500)..(500): a, c, t, g, unknown or other
  misc_feature (500)..(500): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctcccaggcctcctcatctatggtncatcccgcagggccacgtggaactccccagccaggttcagtggcacgtggggtctaggggacaggtagttcactcctacaccatcagcagcctgcagtctagaagtattttgaagtttatttcgtgttctgctagtacaatcagtcgcctggacgttcgacgaagggaccaaaggtggaaactacaaaacgtacgtagtggacngacactactctcgtctactac

SEQ ID NO: 346510 - DNA, 531 bp, Homo sapiens
  misc_feature: GZ8MTXP02JMJ19.21.65.F10.1.454.CMB.2.raw
  modified_base (291)..(291): a, c, t, g, unknown or other
  misc_feature (291)..(291): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgtagcagcaacttagcctggtaccagcagaacctggccagcctccaggctcctcatctatggtncatccgccagggccacgtggaactcccagccaggtcagtcggcacgtgggtctggggacaggtcgttcactctacaccatcagcagcctgcagtctagagtatttagaagtttattctgtctgctagtacatcagtcggacctcggacgttcggacgaacgggacgtaaggtagaaactacgaaaacgtacgtggacggtctagaaccaacgtacttcgtcgttccttactacttccccg

SEQ ID NO: 346511 - DNA, 504 bp, Homo sapiens
  misc_feature: GZ8MTXP02GUI9X.21.65.F10.1.454.CMB.2.raw
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtncatcccgcagggccactggaactcccagcaggttcagtgcagtgggtctgggacngagttcactctcacatcagcagccngcagtcngaaagtnttttagaagtttatttctgtctgcagtacaatcagtcgctggacgttcggacaagggaccaaggtaggaaaactacgaaaacgtacgtgtggctaagacaccatctcgtcttctac

SEQ ID NO: 346512 - DNA, 543 bp, Homo sapiens
  misc_feature: GZ8MTXP02JSV91.21.65.F10.1.454.CMB.2.raw
  modified_base (195)..(195): a, c, t, g, unknown or other
  misc_feature (195)..(195): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgcctgtgtctccgagggganagagccaccctctcctgcagggccagtcagagtgttagcagcaacttagcctggtaccagcagaacctggccagccctccaggctcctnatctatggtcncatcccgccagggccacgtggaactccccagcctaggttcaggtgcacgtgggtctggggacnggtacgttcacgttccncaccntccagcagcctgcagtctagaagttnttttagaagttttntttactgttactgtactagttacaatcgagtcggcctcgggacgttcggaccgaagggtaccaagggtacgaaaactcgaaaacggtactggtaggctgccaactactcttcgtactcgtacc

SEQ ID NO: 346513 - DNA, 513 bp, Homo sapiens
  misc_feature: GZ8MTXP02J08JV.21.65.F10.1.454.CMB.2.raw
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttgcctggtaccagcagaaacctggccagcctcccaggcctcctcatctatggtncatcccgccagggcccagtggaactcccagccaggttcaggtgcacgtggggtctggggacnggagttcactctacaccatcagcagccctgcagtctagaagtatttttagaacgttttattctgtctgctagtacaatcagtcggcctggacgttcgaccaagggccaaaggtggaaaactcaaacgactggtggactgcacgactctcgtcttcac

SEQ ID NO: 346514 - DNA, 511 bp, Homo sapiens
  misc_feature: GZ8MTXP02ISN23.21.65.F10.1.454.CMB.2.raw
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctccaggctcctnatctatggtgcatccgccagggcccacgtggaactcccagccaggttcagtcgcacgtgggtctgggacagngttcactctcaccatcagcagcctgcagtctagaatattttgaagtttattctgttctgctagtacatcagtgctcggacgttcggacaaggggacctaagggtgaaatcgaaaacgtactggtacggctagcacctagtctgtcttcactttccc

SEQ ID NO: 346515 - DNA, 546 bp, Homo sapiens
  misc_feature: GZ8MTXP02IFMFH.21.65.F10.1.454.CMB.2.raw
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgtagcagcaacttgcctggtaccagcagaaacctggccagccctcccaggcctcctcatctatggtncatccgccagggccacgtggaactcccagccaggttcagtggcacgtggggtctggggacngagttcacttcctacaccatcagcagccctgctagtctaggaagttagttttagtaaagttttactttcgttgttctgtactagtacaatcgtagtcggccttcggacgttcgggaccgtaaacggtaccgaaagggtacggaaactacgaaaacgtacgtagtgactgacactatcgtcgttcttactac

SEQ ID NO: 346516 - DNA, 741 bp, Homo sapiens
  misc_feature: GZ8MTXP02HW1HK.21.65.F10.1.454.CMB.2.raw
  modified_base (195)..(195): a, c, t, g, unknown or other
  misc_feature (195)..(195): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggganagcgcccacctctctgcgacggcagtcaggtagttgtacgacacgactaacgtacgcgttacgacacgacgaaacgaacgtcgacacgccctaccgacgtccctcctactacttactagtggtcactaccgtccccgacggaccggacctacggtacggtaccctaccgacgtaccggtacggttaccgagggtcgacctacgggtcgggtcggtacgggactagggttcttaccctacttccctaaccaccgttataccgacgacgaccgtcgtcgacgtacgttacgtaaggttaagttttagtttaaggtttaaacttttcgtttcgttacggttctacgttaacgtaagttaaactacgttagtacgggttccgtaccggtacgggtttaccgggtaccggaaaccggggtaaaccgggaaccggttaaagggggttaaacgtaaaacctaaaaccggggtaaaacgttcgggttacggtaccggtactaaccggaaaccctacgttacgttccggtttacttttacccgttactaaccccg

SEQ ID NO: 346517 - DNA, 528 bp, Homo sapiens
  misc_feature: GZ8MTXP02F3CJZ.21.65.F10.1.454.CMB.2.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtncatcccgccagggccactggaactcccagccaggttcagtgcacgtgggtctgggacngagttcactcncaccatcagcagcctgcagtcagaatatttgaaagttttnttcgtgtctgactagtaacatcgagtcggcctacggacgttcggaccgaaacgggtaccaaagggtagaaaactacgaaaacgtacgtaggtcggactaacgaccactactctacgtcttacacg

SEQ ID NO: 346518 - DNA, 545 bp, Homo sapiens
  misc_feature: GZ8MTXP02J3YX7.21.65.F10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggaccagcagaacctggccacgcctccaggctccnatctatggtncagtccgcagggccagtggaactcccgaagcctaggttcaggtggcacgtgggtctggggacngggtattcactcaccaccancacgcncgccgtgctgtactagtaagttatttagtatttnttcgtgtcngtactaagtactagtcgaggtcgacgtacggtacgggtaccgtacgggaacgaacgggaacgaaggtaacgaaacacgaacgtacgtggtcgcgtacgacctactagtcgtactcctcg

SEQ ID NO: 346519 - DNA, 520 bp, Homo sapiens
  misc_feature: GZ8MTXP02F2BZM.21.65.F10.1.454.CMB.2.raw
  modified_base (194)..(194): a, c, t, g, unknown or other
  misc_feature (194)..(194): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccaccctctcctgcagggccagtcagagtgttagcagcaacttagcctggtaccagcagaacctggccagcctcccaggcctcctcatctatggtgcatcccgcagggccatggaactcccagccaggttcagtggcacgtggtctgggacngagttcatcncacatcagcagcctgcagtctagaagttattttgaaagtttnttctgtctgtcagtacatcgagtcgctcggacgtcgacgaaggaccaagggtagaaactacgaaaacgtacgtaggtcggacgtcgacctaacctacgttctcgttccttactaccg

SEQ ID NO: 346520 - DNA, 519 bp, Homo sapiens
  misc_feature: GZ8MTXP02HJ32J.21.65.F10.1.454.CMB.2.raw
  modified_base (194)..(194): a, c, t, g, unknown or other
  misc_feature (194)..(194): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaacctggccagcctcccaggcctcctnatctatggtncatccgccagggccactggaactcccagccaggttcagtgcacgtggtctgggacngagttcactcncacatcagcagcctgcagtctagaagtattttgaagtttattctgttctgtacagtacaatcagtcggacctggaccgttcggacaagggacctaagggtggaaaactacgaaaacgtacgtagtcggactcggacacctatcgttcgtcctttcacc

SEQ ID NO: 346521 - DNA, 510 bp, Homo sapiens
  misc_feature: GZ8MTXP02IEJ6E.21.65.F10.1.454.CMB.2.raw
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgtagcagcaacttagcctggtaccagcagaaacctggccagcctcccaggctcctnatctatggtncatccgcagggccagtggaactcccagccaggttcagtgcacgtgggtctggggacnggattcactctacaccatcancagcctgcagtctagaatatttagaagtttattcttgtctgtcagttacaatcgagtcgccgtcggacgttcggaccgaaggacgaaggtaggaaactacgaaacgaacgtgtgactgcaacacgtctcgtctttacac

SEQ ID NO: 346522 - DNA, 554 bp, Homo sapiens
  misc_feature: GZ8MTXP02IQN57.21.65.F10.1.454.CMB.2.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtaccagcagaacctggccagccctccaggcctcctcatctatggtncatcccgccagggcccagtggaactccccgagcccaggttccaggtcggcacgtggggtctggggacaggtgttccacttctccaacatccagccagccctgcagtctaggaatattttagaagtttatttctgttctgtcaagtacaattcgaggtcgcctcggacgttcgaccgaaagggccgtaaagggtaggaaaactaacgaaaacgtaccgtagtcggactaacggacacctacgtctcgttacttactacc

SEQ ID NO: 346523 - DNA, 530 bp, Homo sapiens
  misc_feature: GZ8MTXP02JA0ZI.21.65.F10.1.454.CMB.2.raw
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcagaaacctggccagccctcccaggcctcctnatctatggtncatcccgcagggcccagtggaactcccagccaggttcagtgcacgtggggtctggggacnggagttcactcncacatcagcagcctgcagtctagaaagttattttagaagttttattctgttctgctagtacaatcagtcgctggacgttcggacgaaggaccgaaggtagaaaactacgaaaacgtacgtaggtacgacgtcgacctacgactcgtacgtaccttataccg

SEQ ID NO: 346524 - DNA, 525 bp, Homo sapiens
  misc_feature: GZ8MTXP02JW993.21.65.F10.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttgcctggtaccagcagaacctggccagcctccaggctcctnatctatggtncatccgcagggccagtggaactcccagccaggttcacggtgctacgtggggtctggggacnggacgttcacgtctcaccatcagcagcctgcagtcagaatatttagagttttattctgttctgactagtacaatcgagtcgccgtacggacgttcggaccgaagggtaccaagggtagaaactacgaaacgtacgtcggtacggctcgactacctagtcctcgtctactacc

SEQ ID NO: 346525 - DNA, 522 bp, Homo sapiens
  misc_feature: GZ8MTXP02J3OBY.21.65.F10.1.454.CMB.2.raw
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctggtaccagcagaacctggccacgcctcccaggcctcctcatctatgggtncactccgccgagggcccagtggaactcccgagcctaggttcaggtcgcacgtggggtctggggacngagttcactcncaccatcagcagcctgcagtcgtagtaagttntttaggtaatttnttctgtcngcagtacatcgagtcgcctgggacgttcggaccgaagggtaccaagggtagaaactacaaacgactggtcgactgaccacattctctctctaccg

SEQ ID NO: 346526 - DNA, 554 bp, Homo sapiens
  misc_feature: GZ8MTXP02GYLY8.21.65.F10.1.454.CMB.2.raw
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagagccaccctctcctgcagggccagtcagagtgttagcagcaacttagcctggtaccagcaagaaacctggccagccctcccgaggcctcctcatctagtggtncatcccgcaggggccacgtcggaaactcccagccaggttcaggtcggctacgtgggtctgggacagcgttcacgtctacaccatccagcagcctgcagtctagaagttattttagaattttattctggttctgtctagtactaagtcgagttcggcccttagggaccgttcggaccgaacgggaactaagggtacgaaatacgaaaacgtaacgtgtacggctagctaccagttctagtcttactactttcccg

SEQ ID NO: 346527 - DNA, 513 bp, Homo sapiens
  misc_feature: GZ8MTXP02HGZ2P.21.65.F10.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagccctccaggcctcctnatctatggtncatccgccagggccactggaatcccagccaggttcagtgcacgtgggtctggggacngagttcactctcaccatcagcagcctgcagtctagaagtattttagaagttttattctgttctgcagtacaatcagtggcagtcggacgttcgaccgtaaagggaccaaagggtacgaaaatacgaaaacgacgtgtaggctgacacatctcgtacttac

SEQ ID NO: 346528 - DNA, 515 bp, Homo sapiens
  misc_feature: GZ8MTXP02FQN1L.21.65.F10.1.454.CMB.2.raw
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (409)..(409): a, c, t, g, unknown or other
  misc_feature (409)..(409): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagccctcccaggcctcctcatctatggtgcatcccgccagggccactggaactcccagccaggttcagtggcacgtggggtctggggacngngttcactatccacatcagcagcctgcagtctgaagtattttgaaagtttnttctgtctgcagtacaatcagtggcctcggacgttcggaccaagggaccaagggtaggaaactacgaaaacgacgtaggtcggctgaccactactctcgtcttcac

SEQ ID NO: 346529 - DNA, 511 bp, Homo sapiens
  misc_feature: GZ8MTXP02FRNFP.21.65.F10.1.454.CMB.2.raw
  modified_base (294)..(294): a, c, t, g, unknown or other
  misc_feature (294)..(294): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtncatcccgcagggccactggaatccccagccaggttcagtggcacgtggggtctgggacnggagttcactctcacatcagcagcctgcagtctgaagtattttgaagtttatttctgtctgcagtacaatcagtcgcctcggacgttcggccgaaagggacccaaagggtagggaaactacgaaaacgacgtagtaggctgcaccatctcgtcttcac

SEQ ID NO: 346530 - DNA, 535 bp, Homo sapiens
  misc_feature: GZ8MTXP02GVJ01.21.65.F10.1.454.CMB.2.raw
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaattagcctggtaccagcagaacctggccagcctccaggcctcctcatctatggtncatccgcagggccacgtggaactcccagccaggttcagtgcacgtgggtctggggacnggtacttcactctacacatcagcagctgcagtctagaagttatttagaagttttattctgtctgacagttacaatcgagtcggccgtcgggacgttcgggaccgaaggggacctaagggtacgtaaacgtacgaaaacgtacgtggtacggactaacggccaacctatcctacgtccttacgtac

SEQ ID NO: 346531 - DNA, 524 bp, Homo sapiens
  misc_feature: GZ8MTXP02IUF2K.21.65.F10.1.454.CMB.2.raw
  modified_base (195)..(195): a, c, t, g, unknown or other
  misc_feature (195)..(195): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggaccagcctcccaggctcctcatctatggtgcatccgccagggccatggaactcccagccaggttcagtgcacgtgggtctgggacngagttcaacttcncacatcagcagcctgcagtctagaaagtattttgaaagtttatttctgtctggctagttacaaatcgagttcggcctagggacttcggaccaaagggaccaaggtagaaacttacaaaacgactagtcggactggacacctaatctacggtctttacac

SEQ ID NO: 346532 - DNA, 591 bp, Homo sapiens
  misc_feature: GZ8MTXP02GVXSP.21.65.F10.1.454.CMB.2.raw
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (552)..(552): a, c, t, g, unknown or other
  misc_feature (552)..(552): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtacccagcagaacctggccagccctcccaggctcctcatctatggtgcatcccgcgacgggccacgtggaatcccagccaggttnacgtggccacgtggggtctggacnggtagttccactcnccacactcaagccacgcctgcaagttcaggtaagtattttgaaagttttntttactgttacgtganacgttaacaaattccgaaggtcggtacccgttcggaccggtttacgggcccgaaaacggggtaacccgaagggttacgaaaacgtacaaaaccggtaacccgtggtaggtacccngtaccctacccgacttcgttccgttacctttacctaacg

SEQ ID NO: 346533 - DNA, 549 bp, Homo sapiens
  misc_feature: GZ8MTXP02I5SIR.21.65.F10.1.454.CMB.2.raw
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaacctggccagccctcccaggcctcctcatctatggtncatccgccgagggccacgtggaactccccagccaggttcagtggcacgtggggtctggggacngggtacgttccacttcctaccaaccatccaagcagccctgcctagtctagaaagttattttagaaattttattcgtgttctgtctagtacaatcgagtcggcctggacgttcgacgaaagggaccaaagggtaggaaactacgaaaacgtacgtgtcggactgaccactatcgtcgttccttactaccg

SEQ ID NO: 346534 - DNA, 485 bp, Homo sapiens
  misc_feature: GZ8MTXP02FQBFD.21.65.F10.1.454.CMB.2.raw
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatcccgccagggcccatggaatcccagccaggttcagtggcactggggtctggggacngagttcactctcacatcagcagcctgcagtcngaagtattttgaagtttattctgtctgcagtacatcagtgctggctcgcaaggaccaaggtgaaactcaaacgactgtggctgcaccatctgtcttctac

SEQ ID NO: 346535 - DNA, 536 bp, Homo sapiens
  misc_feature: GZ8MTXP02FX5WD.21.65.F10.1.454.CMB.2.raw
  modified_base (359)..(359): a, c, t, g, unknown or other
  misc_feature (359)..(359): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggcctcctcatctatggtgcatccgccagggcccacgtgggaactcccagccaggttccagtcgcacgtgggtctgggacagngttcactctcaccatcagcagccctgcagtctagagtattttgaatttattctagtctgacagttacaatcgagtcgctcggacgttcgacgtaagggacaaagggtagaaaacgtacgaaaacgtacgtacggtacgctcggaaccacgtacgttctagttccttacactttcccg

SEQ ID NO: 346536 - DNA, 539 bp, Homo sapiens
  misc_feature: GZ8MTXP02F76ZW.21.65.F10.1.454.CMB.2.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
  modified_base (408)..(408): a, c, t, g, unknown or other
  misc_feature (408)..(408): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctcccaggctcctcatctatggtncatccgccagggccactggaactcccagccaggttcagtgcacgtgggtctggggacngacgttcacgtctcacatcagcagcctagcagtctagaagtattttagtaagtttntttactgttctgtcagtacaatcagtcgccgtcggacgttcggaccgaacggtaccgaagggttacggaaacgtacgaaaacggtaacgtggtacggactaagaccgaacctactctcgttacttctaacc

SEQ ID NO: 346537 - DNA, 583 bp, Homo sapiens
  misc_feature: GZ8MTXP02JM81R.21.65.F10.1.454.CMB.2.raw
  modified_base (195)..(195): a, c, t, g, unknown or other
  misc_feature (195)..(195): n is a, c, g, or t
  modified_base (370)..(370): a, c, t, g, unknown or other
  misc_feature (370)..(370): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttgcctggtaccagcaagaaacctggaccagccctcccaggcctcctcatctagtggtgcagtcccgcgagggccacgtggaactccccgaagccaggttcaggtcggactacgtggggtctaggggacnggtacgttcactctacaccatcagcagcctgctagtctagaagttattttagaagttttattcgtgttctgactagttaacaatcgaggtcggccgttacggtaccgttacggaccgaaaggggtaccgaaggggtacgaaaacgtacgaaaacggtacgtgggtacgtaccgtgaccgtaacctacgttccgttacgttaccttacgtaccg

SEQ ID NO: 346538 - DNA, 677 bp, Homo sapiens
  misc_feature: GZ8MTXP02JWN66.21.65.F10.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagcccaccctgtctgtgtctccgagggganagacgcccaccctctcctgcgagggccagtcagtagtgttagcagactaacgttagccgtaggtaccagaccaacggaaacccgtggaccccacggcccctaccccgacggtcccttccctactaacttccgtaagttcgggtcgacctacgtccccggaccggacggggtaccctacggtacgggaacctccccggacgtcccgtagggttcgacgggtcggaccgtacggtcggggtacgtaggggactaggtcgttacaccttccaccacctactaccgacgccgacgccctagaccgttagtacgtaggtaagtttagttttagttaagtttttcttcgtgttctgtactagtactagtcgacggtcgtccgtacgggacgttacggacgaacgggtacggtaagggtacgaaacgtacgaaacgtacgtcggtacgcgtaacgaccgtactacgttcctacgttctacgtttcc

SEQ ID NO: 346539 - DNA, 540 bp, Homo sapiens
  misc_feature: GZ8MTXP02FMW70.21.65.F10.1.454.CMB.2.raw
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccagctcctcatctatggtgcatcccgcagggccactggaactcccagccaggttcaggtggcacgtgggtctgggacngngtcactctcaccatcagcagcctgcagtcagaagtatttttgaaagttttatttctgttctcggactagttacaatcgaggtcggcctcgggaccgttcgggaccgaaaggggaccaaagggtaggaaaactacgaaaacggtacgtaggtggactaacggacaacctatcgtacgtcttactaacg

SEQ ID NO: 346540 - DNA, 541 bp, Homo sapiens
  misc_feature: GZ8MTXP02GR6MF.21.65.F10.1.454.CMB.2.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctccaggctccncatctatggtncatccgcagggccactggaactcccagccaggttcaggtggccacgtggggtctggggacnggagttcactctcaccatcagcagcctgctagtctagaagtattttagaagtttatttctagttcttgctagtacaatcgagtcggcctacgggaccgttcgggaccgtaaaggggacctaaagggtaggaaaactacgaaaacgtacgtaggtggactaaggctaaccatctacgtccttactacc

SEQ ID NO: 346541 - DNA, 556 bp, Homo sapiens
  misc_feature: GZ8MTXP02GYC7L.21.65.F10.1.454.CMB.2.raw
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcaagaaacctggccagccctcccaggcctcctcatctagtggtgcatcccgccagggcccacgtggaactcccgagccaggttcaggtcgcacgtgggtcngggacngacgttcactctcacatcagcacgcctgcagtctagaagttatttagtatttattctgtctgctagtacaatcaggtcggaccgtcgggtacgttacggaccgtaaacggggaccaaagggtacggaaactacgaaaacgtacgtaggtcggacgtcggacctaaccgtattccgttacgttaccttactacccg

SEQ ID NO: 346542 - DNA, 517 bp, Homo sapiens
  misc_feature: GZ8MTXP02HCO5K.21.65.F10.1.454.CMB.2.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctcccaggctcctcatctatggtncatccgccagggccactggaactccccgagccaggttcacggtggcacgtggggtctggggacnggtgttcacttctcaccatcagcagcctgcagtcngaagttnttttagaagttttacttctgttctgctagtacaatcagtcgctcggacgttcgacgaagggaccaaggtggaaactacaaaacgtacgtacggtgactgcacgatcgtgtcctctac

SEQ ID NO: 346543 - DNA, 517 bp, Homo sapiens
  misc_feature: GZ8MTXP02GLV41.21.65.F10.1.454.CMB.2.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (405)..(405): a, c, t, g, unknown or other
  misc_feature (405)..(405): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccacccctctcctgcagggccagtcagagtgttagcagcaacttagcctggtaccagcagaacctggccagccctccaggctacncatctatggtncatcccgcagggccactggaactcccagccaggttcagtgctacgtgggtctgggacngacgttcactcncaccatcagcagcctgcagtcagaagtatttgaagttttnttctgtctgcagtacatcagtcggctcgggacgttcggaccgaagggaccaagggtgaaaataccgaaaacgtacgtggtacggctaacgacactacgtctcgtccttctac

SEQ ID NO: 346544 - DNA, 543 bp, Homo sapiens
  misc_feature: GZ8MTXP02HPQYY.21.65.F10.1.454.CMB.2.raw
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (509)..(509): a, c, t, g, unknown or other
  misc_feature (509)..(509): n is a, c, g, or t
  modified_base (527)..(527): a, c, t, g, unknown or other
  misc_feature (527)..(527): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcagaaacctggccagcctcccaggcctcctnatctatggtcncacgtcccgcgagggccacgtggaactcccagccaggttcaggtggcagtgggtcngggacngtattcactctcacntcagcagcctgctagtctagtaagtatttttagaagtttttattcgtgttctagactagtacaattcgagtcggccgtagggtaccgttcggacgaaacgggacgtaaagggtagaaacttacgaaaacgtacgngttggactaagccaactntactcgttctactacg

SEQ ID NO: 346545 - DNA, 585 bp, Homo sapiens
  misc_feature: GZ8MTXP02HLF8G.21.65.F10.1.454.CMB.2.raw
  modified_base (195)..(195): a, c, t, g, unknown or other
  misc_feature (195)..(195): n is a, c, g, or t
  modified_base (370)..(370): a, c, t, g, unknown or other
  misc_feature (370)..(370): n is a, c, g, or t
  modified_base (426)..(426): a, c, t, g, unknown or other
  misc_feature (426)..(426): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcagaaacctggccagccctcccgaggcctcctcatctatggtcgcactcccgccgacgggccacgtggaactcccgagccgtaggttcaggtcggctacgtgggtctaggggacnggtacgttcactctcaccatcagcacgctgctagtctagaattatttagaattttntttcgtgttctggtactaagtactaagtcgtaggtcggccgttacgggtaccgtttaccgggaccgtaaaagggggtaccctaaaggggtacgaaaactacgaaaacggtacgttcggtacggctaagaccctaacgtacttcgtcgttcttacgtacc

SEQ ID NO: 346546 - DNA, 529 bp, Homo sapiens
  misc_feature: GZ8MTXP02FOA7H.21.65.F10.1.454.CMB.2.raw
  modified_base (297)..(297): a, c, t, g, unknown or other
  misc_feature (297)..(297): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgactcagtctccagccaccctgtctgtgtctccgaggggagagagcccaccctctcctgcagggccagtcagagtgttagcagcaacttagcctggtaccagcagaaacctggccagccctccaggcctcctcatctatggtncatcccgcagggccacgtggaactcccagcctaggttcaggtggcacgtgggtcnggggacnggattcactcncaccatcagcagcctgcagtcagaagtatttgaaagtttnttctgttctgctaagtacaatcgagtcggccctgggacgttcggaccgaagggaaccaagggtagaaaactacgaaaacgactggtacgctaacgccactactcgtagtccttactacc

SEQ ID NO: 346547 - DNA, 544 bp, Homo sapiens
  misc_feature: GZ8MTXP02JRT1A.21.65.F10.1.454.CMB.2.raw
  modified_base (294)..(294): a, c, t, g, unknown or other
  misc_feature (294)..(294): n is a, c, g, or t
  modified_base (397)..(397): a, c, t, g, unknown or other
  misc_feature (397)..(397): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctcatctatggtncagtccgcagggccacgtggaactcccagccaggttcagtcggacacgtgggtctgggacaggtcgttcactctcacatcagcagcctgctagtctagaagtntttagtaagttttattcttagtcttagctaagtacagtcgagtcggacctcggtacggttcggaccgtaagggaacctaaggggtagaaactacgaaaacggtactcggacgtcgtgaacgacctatctgtccttacacgtttcccg

SEQ ID NO: 346548 - DNA, 527 bp, Homo sapiens
  misc_feature: GZ8MTXP02JSPF9.21.65.F10.1.454.CMB.2.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (418)..(418): a, c, t, g, unknown or other
  misc_feature (418)..(418): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagcccaccctgtctgtgtctccgagggganagagccaccctctcctgcagggccagtcagagtgttagcagcaacttagcctggtaccagcaagaacctggccagccctcccaggcctcctcatctatggtncatccgcagggccagtggaactcccagccaggttcagtgcacgtggggtcngggacnggtacgttcactctacaccatcagcagcctagctagtctaggaattattttagaaagttttnttcgtgttctgctaagtacaatcgagtcgcctcgggacgttcggacgaagggacgaaggtagaaactacgaaacgtactggtacgctaagcctactatctctctactac

SEQ ID NO: 346549 - DNA, 559 bp, Homo sapiens
  misc_feature: GZ8MTXP02IPS7C.21.65.F10.1.454.CMB.2.raw
  modified_base (197)..(197): a, c, t, g, unknown or other
  misc_feature (197)..(197): n is a, c, g, or t
  modified_base (266)..(266): a, c, t, g, unknown or other
  misc_feature (266)..(266): n is a, c, g, or t
  modified_base (358)..(358): a, c, t, g, unknown or other
  misc_feature (358)..(358): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggagaaatagtgatgacgcagtctccagccaccctgtctgtgtctccgaggggganagagcccaccctctcctgcagggccagtcagagtgttagcagcaacttgcctggtaccagcagaaaccnggccagcctcccaggcctcctcatctatggtgcatcccgcagggccacgtggaactcccgagccaggttcagtggcacgtgggtctgggacnggtagttcactcctacacatcagcacgcctgcagtctagtaaatattttaggaatttatttctgttctgtactagttacaaatcaaggtcgtccctcgggtaaccgttcggaccgaaaggggacctaaagggtaagaaaactaaccgaaaacgtacgtaggtacgacgtaacgacaacctagtcctcgtcctttacaaccg

SEQ ID NO: 346550 - DNA, 506 bp, Homo sapiens
  misc_feature: GZ8MTXP02FW650.21.65.F10.1.454.CMB.2.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctnatctatggtncatccgcagggccatggactcccagcaggttcagtgcacgtggtctgggacngtagtcactcncacatcagcagcngcagtcngagtatttgaagtttnttctgtntgactagtacaatcgagtcggctaggacgttcggacaaggggaccaagggtagaaactacgaaaacgtaactgtacggctaagacaccatccgtagtcttactac

SEQ ID NO: 346551 - DNA, 593 bp, Homo sapiens
  misc_feature: GZ8MTXP02HGN6C.21.65.F10.1.454.CMB.2.raw
  modified_base (195)..(195): a, c, t, g, unknown or other
  misc_feature (195)..(195): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcaagaaacctggccagccctccagctcctnatctatggtncactcccgcgacgggccacgtaggaactccccaagccccgtaggttcacgtcggccacgttggggtcctggggacctaggtacgtttcaacttcctaccaccctatccaagccacgccctggacctagttcgtagtaaagtttagtttagtaaagttttactttcgttgttcgtgtacaattacaaattcgaggttcgccgtacggtacgtcgacgaacggaacgaagggtaaggaaactacgaaaacgtacgtagtcggtacgtaaccgactaaccacttcgtactctttactaccg

SEQ ID NO: 346552 - DNA, 543 bp, Homo sapiens
  misc_feature: GZ8MTXP02ISVGS.21.65.F10.1.454.CMB.2.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcaagaaacctggaccagccctcccaggcctcctcatctagtggtcncactcccgccgacgggcccacgtggaactccccgagcctaggttcagtcggcacgtggggtctgggacnggtacgttcactctacaccatcagcagccctgactagtctagtaagttatttagtaagttttattctgttctgtacagtacatcgagtcgcctggacgttcgacgaaggacaaggtagaaactacgaaacgtacgtggtcgactaacgacactactcgtcgtcttactacg

SEQ ID NO: 346553 - DNA, 511 bp, Homo sapiens
  misc_feature: GZ8MTXP02HPZNU.21.65.F10.1.454.CMB.2.raw
  modified_base (296)..(296): a, c, t, g, unknown or other
  misc_feature (296)..(296): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttgcctggtaccagcagaaacctggccagccctccaggcctcctcatctatggtncatcccgcagggccagtggaactcccagccaggttcagtggctacgtggggtctggggacaggtacgttcactcctacaccatcagcagcctgcagtctagaattatttgatttattctgtctgcagtacatcagtcgcctggacgttcgacgaaggacaggtagaaactacgaaacgtacgtagtgctggacaccgtatcgtctcttactaccg

SEQ ID NO: 346554 - DNA, 553 bp, Homo sapiens
  misc_feature: GZ8MTXP02HQCYX.21.65.F10.1.454.CMB.2.raw
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagagccaccctctcctgcagggccagtcagagtgttagcagcaacttagcctggtaccagcagaacctggccagcctcccaggctcctcatctatggtgcatcccgccagggccacgtggaactcccagccaggttcagtcggcacgtgggtctggggacagcgttcactctccaccatcagcagcctgcngtctagaagttnttttagaagttttattctgttctgactagtactaatcgagtcggctcggtacgttcggaccgaagggaaccgtaaggtagggaaaactaccgtaaaacggtacttggacgggtctacggaaccacccgtattccgtgttaccttcttattccccg

SEQ ID NO: 346555 - DNA, 533 bp, Homo sapiens
  misc_feature: GZ8MTXP02HSV5Z.21.65.F10.1.454.CMB.2.raw
  modified_base (194)..(194): a, c, t, g, unknown or other
  misc_feature (194)..(194): n is a, c, g, or t
  modified_base (361)..(361): a, c, t, g, unknown or other
  misc_feature (361)..(361): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccaccctctcctgcagggccagtcagagtgttagcagcaattagcctggtaccagcagaaacctggccagcctcccaggcctcctcatctatggtgcatcccgcagggcccactggaactcccagtcccagggttcagtcggctacgtggggtctggggacnggtagtttccacgttcctacaccatcagcagctgcagtctagaagtattttgaatttatttctgtcttgcagtacaattcagtcgctcggacgttcggaccgaagggaccaagggtagaaactacgaaaacgtacgtgtacggatcgacacctagttctcgtactttctacc

SEQ ID NO: 346556 - DNA, 581 bp, Homo sapiens
  misc_feature: GZ8MTXP02GX8R5.21.65.F10.1.454.CMB.2.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (355)..(355): a, c, t, g, unknown or other
  misc_feature (355)..(355): n is a, c, g, or t
  modified_base (397)..(397): a, c, t, g, unknown or other
  misc_feature (397)..(397): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccagggganagagccacctctcctgcagggccagtcagagtgtagcagcaacttagcctggtaccagcaagaaacctggccagcctccaggcctccnatctatggtncatccgccagggccacgtggaactcccagccaggttcagtcggcacgtgggctggggacaggngttcactctacacatcagcacgcctgacagtctagaaagttnttttagaagttttattcgtagttctagctaagtaactagtacaggttcgacccgttacgggaccgttcggaaccgaaaggggaaccgtaaagggtacggaaaactaaccgaaaacgggtacttacgggtcggaccttaggaaccctaaaccgtattccgtcgttacctttactactttcccccg

SEQ ID NO: 346557 - DNA, 523 bp, Homo sapiens
  misc_feature: GZ8MTXP02IK6FO.21.65.F10.1.454.CMB.2.raw
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (379)..(379): a, c, t, g, unknown or other
  misc_feature (379)..(379): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccaggggagagagccaccctctcctgcagggccagtcagagtgttagcagcaacttagcctggtaccagcagaaacctggccagcctcccaggcctcctcatctanggtgcatccgcaggccactggaactcccagccaggttcagtcggcacgtgggtctggacnggattcactcctacacatcagcagtccngcagtctagaaagtnttttagaaagtttntttacgtnttctgactagtacaagtcagtcgactcggacgttaggccgaaaggacaagggtaggaaactacgaaaacggactaggtgactgacctacgattccgtgtacttctac

SEQ ID NO: 346558 - DNA, 534 bp, Homo sapiens
  misc_feature: GZ8MTXP02G8OAB.21.65.F10.1.454.CMB.2.raw
  modified_base (195)..(195): a, c, t, g, unknown or other
  misc_feature (195)..(195): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcagaaccnggccagcctccagctccnatctatggtncatccgcagggccactggaactcccagccagttcagtgcacgtgggcngggacnggattcactctcacatcagcagcctgcagtctagaagtattttagaagtttattcgtgttctagtctaagttacaatcgtaagtcggccgtacggacgttccggaccgaaagggaccaaaggtaggaaaactacgaaaacgtacgtagtacgacgtaacgacaacctagttctacgtcctttactaccg

SEQ ID NO: 346559 - DNA, 569 bp, Homo sapiens
  misc_feature: GZ8MTXP02FWRPV.21.65.F10.1.454.CMB.2.raw
  modified_base (291)..(291): a, c, t, g, unknown or other
  misc_feature (291)..(291): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggaccagcagaaacctggccagcctccagctcctcatctatggtncatccgcaggccacgtggaactcccagccaggttcagtgacacgtgggtctagggacaggattcactcacaacatcagcagtctcgacagtacgtagtaagtagtttagttaagtttaatttacttcgttcgtacgtactaacgtaactaaactacgtacgtacggtccgtacggtacggtacggtacgaacggaacggtaaacggtaaggtaaacgtaaacgtaaacgaaacgtaacgtaggtacgtaacgtacgactactactacgtacttactac

SEQ ID NO: 346560 - DNA, 520 bp, Homo sapiens
  misc_feature: GZ8MTXP02GMKV6.21.65.F10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcagaacctggccagcctccaggctcctnatcatggtncatcccgcagggccagtggaactcccagccaggtcagtgcacgtggggtcnggggacngngttccacttcncaccatcagcagcctgcagtctagaagtatttgaagtttnttctgtctgtacagtactaatcgagtccggcttacgggacttccgggacgaaacgggtaccaagggtagaaactacgaaacgacgtgagcaagtcacgtactctacgtacttctac

SEQ ID NO: 346561 - DNA, 608 bp, Homo sapiens
  misc_feature: GZ8MTXP02IY1GP.21.65.F10.1.454.CMB.2.raw
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
  modified_base (454)..(454): a, c, t, g, unknown or other
  misc_feature (454)..(454): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagactaacttagcctggtaacccagcaacgaaacctggacccacgccctcccgaggtcctcctcatctatggtncactcccgcgagggccacgtggaactcccgagcccgtaggttccaggtcggcctacggtgggtctaggggacagggtcttaccactcctaccaccatccagcacgtccctgctagtctaggtaagtttagtttagtaaagtttntttcgtgttctgtactaagtactaaatcgagttcggccgtacgggtacgttcggaacgtaaacgggtaccgtaagggtacggaaaactaccggaaaacgtacgtagggtacgacgtaacgaccgtaacctagttccgttacgttccttactacc

SEQ ID NO: 346562 - DNA, 518 bp, Homo sapiens
  misc_feature: GZ8MTXP02H9IVG.21.65.F10.1.454.CMB.2.raw
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgtagcagcaacttagcctggtaccagcagaaacctggccagcctcccaggcctcctcatctatggtncatcccgcgagggccatggaatcccagccaggttcagtgcacgtggggtctggggacnggtagttcacttctcactatcagcagcctgcagtctagaatatttagagtttattctgttctgtctaagtacaatcgagtggcctcggcgttcggactaaagggaccaaggtaggaaactacgaaacgtactaggtcgctaagccactattctacgttctacgtac

SEQ ID NO: 346563 - DNA, 638 bp, Homo sapiens
  misc_feature: GZ8MTXP02GBXQ0.21.65.F10.1.454.CMB.2.raw
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaaacctggccagccctcccaggcctcctcatctatggtncactcccgccgacgggcccacgtggaactccccagccaggttcaggtggcacgtgggtctggggacnggtacgttcactcctccaacctatcagcagcctgcagtctagtaagttattttagtaaagttttatttcgtgttcttagtactaagttaacctaagttccgaggttcggtacccgttacgggggtaaccggttccggggaacccggaaaacgggggtaacccgtaaaagggggttaacggtaaaacgtaaaccggaaaaaccggtaacggttagggtacgggtaccgtaacggacccgtaacctacgttcctttacggtacctttactacccg

SEQ ID NO: 346564 - DNA, 606 bp, Homo sapiens
  misc_feature: GZ8MTXP02GEFVG.21.65.F10.1.454.CMB.2.raw
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (419)..(419): a, c, t, g, unknown or other
  misc_feature (419)..(419): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgtagcagcaacttagcctggtaccagcagaaacctggccagccctccaggcctcctcatctatggtncatcccgcagggccacgtggaactcccagccgaggttcacgtggcacgtggggtctgggacnggtcgttcactctcacatcagcacgcctgctagtctgtaagttagtttagtaaacgttttntttcgtgttctaggtctaagttactaaagtctaaggttcggcccgttacgggtacggtttaccggaccgtaaacgggggaacccgtaaaggggttacggaaaacgttaccgaaaacggtaccgttagggttacgggcttaacggacccgtaaaccggtacttacgtacggtttccttactttacccg

SEQ ID NO: 346565 - DNA, 668 bp, Homo sapiens
  misc_feature: GZ8MTXP02JV3LM.21.65.F10.1.454.CMB.2.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
tcagtcgtcgctcgcacgaccggtgctcgatttagctacgctctaagggggaggaacgtgctcagttaggacccagacggaaccatggaagccccagcgcagcttcgtccttcctcctgctactcgtggctcccagaaagctctggacgaaatagtgatgacgcagtctcagccaccctgtctgtgtcctccgagggganagacgccacccctctccgtgcagggccagtcagagtgttagcagctaattagcctggtaccagcagaacctggccagcctccaggcctccctnatctatggtcgcatcccgacgagggccctacgtcggaactccccgaagccgaggttccaacggtcggacctacggttggggtcctggggaaccagggtagttcaaccgttcgaccaaccctagtccaacgcctaacgcccgttgaccctaaggttcctaggaaacgtttgtttttaaggaaacgtttttactttacgttgtttaccgtaggacccttaaggttacctaaagttccaaaggggtttccggaccgttaccgggtaccgtttaccgggaccctaaacggggtaccgaagggttacgaaacgttacggaaaaccgtaacgtcggtaggactaacggtaccaaccgtagtaccgttcgtacctctaaccg

SEQ ID NO: 346566 - DNA, 572 bp, Homo sapiens
  misc_feature: GZ8MTXP02F8OBT.21.65.F10.1.454.CMB.2.raw
  modified_base (194)..(194): a, c, t, g, unknown or other
  misc_feature (194)..(194): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagacgccaccctctcctgcagggccagtcagagtgttagcagcaacttagccttgggtaacccagcaacgaaacctggacccaggccctcccgaggcctcctacatcgtaatggtncatcccgcagggccatggaactcccagccaggttcagtcgcacgtgggtcngggacaggtcttcactctcaactatcagcagcctagcagtcagtaatagtttgtaaagtttntttctagtcctagtactaagttaacaatcgaaggttcggcccgttagggacgttcggaccgaaaggggtaccgtaaaggtaacgtaaactacgaaaacgacgtagtacggacctaacgacgtaacctactcgttacgttcttactaccg

SEQ ID NO: 346567 - DNA, 513 bp, Homo sapiens
  misc_feature: GZ8MTXP02J00P6.21.65.F10.1.454.CMB.2.raw
  modified_base (194)..(194): a, c, t, g, unknown or other
  misc_feature (194)..(194): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaacctggccagcctccagctcctcatctanggtncatccgccagggcccagtggaactcccgagccaggttcacgtggcacgtggggtctggggacnggacgttcacgtctccacctatcagcagcctgcagtctagaagtatttagagtttattctgtctgcagtacatcaggttgcctcgacgttcgaccgaaggtaccgaaggtagaaactacaaacgacgtggtcgcgtgccacgactctcgtcttactacc

SEQ ID NO: 346568 - DNA, 515 bp, Homo sapiens
  misc_feature: GZ8MTXP02FMLU7.21.65.F10.1.454.CMB.2.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagccctcccaggcctcctcatctatggtgcatccgccagggccacgtggaactcccagccaggttcagtggcacgtgggtcngggacnggacttcactctcacatcagcagcctgcagtcngaagtattttgaagttttatttctgtctgcagtacaatcagtcgcctcggacgttcggccgaaagggaccgaaggtaggaaaactacgaaaacgaactggtggactgacacatctcgtcttactac

SEQ ID NO: 346569 - DNA, 633 bp, Homo sapiens
  misc_feature: GZ8MTXP02F3JJS.21.65.F10.1.454.CMB.2.raw
  modified_base (195)..(195): a, c, t, g, unknown or other
  misc_feature (195)..(195): n is a, c, g, or t
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtaccagcaagaacctggaccagccctccaggcctcctcatctagtggtcnctacgtcccgcgagggcccacgtggaactcccgagcctaggttcacggtggcctacggtcggggtctaggggaacnggtacgttcacttcctaccaccatcacgcacgccctgctagtctaggtaaagtttattttaggaaagtttttatttcgttagttctgtacctaagttaaccaagtccgtaagggttcggtacccgttacgggtaccgtttaccgggaccgaaaacggggtaaccgtaaagggggttaacgaaaacgttaaccgaaaacggtaacgtggtacggaccgtaacggaccaaccgtagtaccgtttcgttaccgtactacg

SEQ ID NO: 346570 - DNA, 635 bp, Homo sapiens
  misc_feature: GZ8MTXP02GOO9Z.21.65.F10.1.454.CMB.2.raw
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttgcctggaccagcagaacctggccagcctcccaggcctcctcatctatggtncactcccgcgagggccacgtggaactccccgagccaggttcaggtggcacgtggggtctggggacnggtacgttcaccttctaccacctatccagcacggccctggacagttctaggtaaagtttagtttttaggtaaatttttacttttcgttggttaccttgggtacctaaggttacctaagttccgtaagggttcgggtacccgttacggggtaccggtttaccgggaccgtaaaacgggggtaccgaaaaggggttacggaaaactaccgaaaacggtacgtcggtacggacctaaggaccctaaccgtacgttcgttacgttcctttacgtaccg

SEQ ID NO: 346571 - DNA, 546 bp, Homo sapiens
  misc_feature: GZ8MTXP02GFI0R.21.65.F10.1.454.CMB.2.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctccagctcctnatctatggtncatcccgcagggccacgtggaactccccagccaggttcagtcgcagtggggtctaggggacaggacgttcactcctcaaccatcagcagccctgcagtcagaagttnttttagaagtttntttcngttctgactagtaacaatcgagtcggcctagggaccgttacggaccaaaggggaccaaagggttacggaaaactacgaaaacgtacgtaggtcggactaacgacactacgtcttacgtcctttactacc

SEQ ID NO: 346572 - DNA, 575 bp, Homo sapiens
  misc_feature: GZ8MTXP02GIFIX.21.65.F10.1.454.CMB.2.raw
  modified_base (298)..(298): a, c, t, g, unknown or other
  misc_feature (298)..(298): n is a, c, g, or t
  modified_base (420)..(420): a, c, t, g, unknown or other
  misc_feature (420)..(420): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctccagaaagctctggagaaatagtgatgacgcagtctccagccaccctgtctgtgtctccgaggggagagagcccaccctctcctgcagggccagtcagagtgttagcagcaacttagcctggtaccagcaagaaacctggaccagcctcccaggcctcctcatctatggtncatccgcagggccacgtggaactcccgagccaggttcagtggcacgtggggtctaggggacaggtcgttcacttcctacaaccatcagcacgcctgcagttcagtaagtatttgaaagtttnttactgtctgactagtacaatctacggtcggtacctcgggtaccgttacgggacccgaaaggggtaaaccgtaagggttaaggaaaacttacggaaaacggtaacttgggtacggactaaggacccaacctagttccgtcgttacttactaaccg

SEQ ID NO: 346573 - DNA, 685 bp, Homo sapiens
  misc_feature: GZ8MTXP02G5BZW.21.65.F10.1.454.CMB.2.raw
  modified_base (196)..(196): a, c, t, g, unknown or other
  misc_feature (196)..(196): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaattagcctggtaccagcagaaacctggccagcctcccaggcctcctcatctatggtgcacgtccgccgagggcccacgtggaactcccgagccaggttcaggtggcacgtggggtctggggacaggtacgttcacttcctaccaaccatccaagccaacggtccctaggacctaagttccgtaggtaaaagttatttttagaaagtttttatttccgttggttaccttggtacctaaggtttaaaccaaagttcccgtaagggttcgggtaccccgttacgggggtaaccgtttacccggggaacccgtaaaaacgggggaaccccgtaaaaggggttacgggaaaaaacttaccgaaaaaaaccggtaaccgtttaggtacggggaccttaacggaacccgtaaaccccgtattccgttaacggtttcccttttaccgtaacccg

SEQ ID NO: 346574 - DNA, 585 bp, Homo sapiens
  misc_feature: GZ8MTXP02GP6J5.21.65.F10.1.454.CMB.2.raw
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagcctccaggcctcnatctatggtncatcccgcagggccacgtggaactcccgagccaggttcacgtgcacgtggggtctgggacngtgttcactctcacatcagcagcctgcagtcagtaatattttagaagttttatttcgtgttctgtacagttaactaactcgacggttcggtcccgttacgggtacggtttacccgggaccgaaaacggggtacccgtaaaaggggttacggaaaacttaccgaaaaacggtacgtacggtcggaccgtaacggacctaacccgtagttccgtacggttacctttactaaccg

SEQ ID NO: 346575 - DNA, 546 bp, Homo sapiens
  misc_feature: GZ8MTXP02IH232.21.65.F10.1.454.CMB.2.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (424)..(424): a, c, t, g, unknown or other
  misc_feature (424)..(424): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgtagcagcaacttagcctggtaccagcaagaacctggccacgcctcccaggcctccncattctagtggtncactccgcgaggccacgtggaactcccagcctaggttcagtcgacngtcgggctgggacagtgttcactctaccacatcgagcacgtcctgactagtctagtaagttatttttaggaaagttttntttccgtgtctgactaagtacaatcgagttcggccgttcgggaacttcggacgtaagggaccgaggtagaaactacgaaacgtacgtacgtggctaagccaacgtctattcgtcttacgtac

SEQ ID NO: 346576 - DNA, 521 bp, Homo sapiens
  misc_feature: GZ8MTXP02IOPMK.21.65.F10.1.454.CMB.2.raw
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccacctctcctgcagggccagtcagagtgtagcagcaacttagcctggtaccagcagaaacctggccagcctcccaggcctcctcatctatggtncatcccgcagggcccagtggaactccccagccaggttcagtggctagtgggtcngggacnggnttcactctcacatcagcagcctgcagtctagaagtnttttgaaagtttntttacttgttctgtctagtacatcgagtcggctcggacgttcggaccgaagggtaccaaagggtagaaactacgaaacgtacgtacgtggctggacacgtactctcgttactctac

SEQ ID NO: 346577 - DNA, 567 bp, Homo sapiens
  misc_feature: GZ8MTXP02HMPDY.21.65.F10.1.454.CMB.2.raw
  modified_base (295)..(295): a, c, t, g, unknown or other
  misc_feature (295)..(295): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtncatccgccagggccatggaactcccagccaggttcagtcggcacgtggggtctggggacaggtacgttcacttctaccgaccatcagcacgcctgctagtctagtaagtattttagaagttttatttcgtgttctagtctagtactaatcgaggtcggcctcgggaaccgtttcggaccgaacgggtaccgaaaggggtggaaaaactcgaaaacggtacgtaggttcgggacttggacctaaccctataccgttcgtacctttactaaccg

SEQ ID NO: 346578 - DNA, 594 bp, Homo sapiens
  misc_feature: GZ8MTXP02HRK9U.21.65.F10.1.454.CMB.2.raw
  modified_base (296)..(296): a, c, t, g, unknown or other
  misc_feature (296)..(296): n is a, c, g, or t
  modified_base (430)..(430): a, c, t, g, unknown or other
  misc_feature (430)..(430): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagagccaccctctcctgcagggccagtcagagtgtagcagcaacttagcctggtaccagcagaacctggccagccctccaggcctcctcatctagtggtcncactcccgcgacgggccagtcggaactccagcctaggtcaggtcgactacgtggggtctgggactggtacgttcactcctccactatccagcagcctagctagtctaggtaagttattttaggtaaagtttttntttcgttgttcttggtactaagttacaattcgaggttcggccgtacgggtacggttacggaccgaaaggggtaccgaaagggttacggaaaacgtaaccgaaaacggtacggtacgtacgggactaaccggactacgtactacgttcgttacctttactacccg

SEQ ID NO: 346579 - DNA, 590 bp, Homo sapiens
  misc_feature: GZ8MTXP02HQI10.21.65.F10.1.454.CMB.2.raw
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgtagcagcaacttgcctggaccagcagaaacctggccagcctcccaggcctcctcatctagtggtcgcatcccgccgagggcccacgtggaactcccgagccgaggttcaggtgcctacgtggggtctggggacaggtacgttcacgttcctacgaaccatccaagtcacggtcctaggcctagttcctaggtaacgtttagtttagtaaagttttatttctggttctgtactaagttacaattcgaggtcggccgtcgggtaccgttccggacgaacgggaccgtaagggtacgaaaacttacgaaaacgtacgtggtacgtactcgactaccgtacgtcttacgtcctttacgtacccg

SEQ ID NO: 346580 - DNA, 578 bp, Homo sapiens
  misc_feature: GZ8MTXP02G4ER0.21.65.F10.1.454.CMB.2.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (425)..(425): a, c, t, g, unknown or other
  misc_feature (425)..(425): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagcaacttagcctggtaccagcaagaacctggccagccctcccaggcctcctcatctatggtncactcccgcgagggccacgtggaactcccgagccaggttcagtcggctacgtggggtctgggacngtcgttcacttcncaccatcgancagcctgctagtcgtagaagttattttagtaagtttnttctagttctagctaagtacaagtcgagtcggtctacgggtacgttcggacgaaacggggtacaaagggttaggaaaactacgaaaacggtacgtaggtacgggtacctaacggacctaacccgtagttccttcgtttaccctacttaccccg

SEQ ID NO: 346581 - DNA, 532 bp, Homo sapiens
  misc_feature: GZ8MTXP02HYHFM.21.65.F10.1.454.CMB.2.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccaccctctcctgcagggccagtcagagtgtagcagcaacttgcctggtaaccaggcaagaaacctggccacgcctcccaggcctcctnatcatggtncatccgcaggcatgaacnccagccaggtcagtgctacgtggggctggggaacaggtacttcactctacacatcagcagtcctgacagtctagaatatttagtaatttattctgtctgtatatacatatagtcgtcgtcggtacgttacgacgaacggaaccgaaaggtaaggtaaagtaaacgaaaacgtaaacgacgtaggacgtaacgacaactactactctacttactacc

SEQ ID NO: 346582 - DNA, 521 bp, Homo sapiens
  misc_feature: GZ8MTXP02H947Q.21.65.F10.1.454.CMB.2.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccaggggagagagccaccctctcctgcagggccagtcagagtgttagcagcaacttagcctggtaccagcagaaacctggccagcctcccaggcctcctcatctatggtncatccgcagggcccacgtggaactcccagccaggttcacgtggcacgtgggtctgggacnggattcactctcacatcagcagcctgcagtctagaatattttagagtttatttctgttctgtctagtacatcagtcgctcggacgttcgacgaacggaccaaggtaggaaaactacgaaaacgtacgtaggtcggacgtgaccctacctatcgtcgttccttactac

SEQ ID NO: 346583 - DNA, 535 bp, Homo sapiens
  misc_feature: GZ8MTXP02FH53B.21.65.F10.1.454.CMB.2.raw
  modified_base (299)..(299): a, c, t, g, unknown or other
  misc_feature (299)..(299): n is a, c, g, or t
  modified_base (361)..(361): a, c, t, g, unknown or other
  misc_feature (361)..(361): n is a, c, g, or t
  modified_base (508)..(508): a, c, t, g, unknown or other
  misc_feature (508)..(508): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaaacctggccagccctcccaggcctcctcatctatggtncatcccgccagggcccagtggaactccccagccaggttcagtggcacgtgggtctggggacngagttcactctcacatcagcagcctgctagtcagaaagttattttgaaagtttttatttctgttctgctagttaacatcaggtcgtccgtcggacgttcggaccgaaagggacctaaagggtaggaaaactacgaaaacggactagnggtactcgacaccatctcgtcttctac

SEQ ID NO: 346584 - DNA, 569 bp, Homo sapiens
  misc_feature: GZ8MTXP02G4TUV.21.65.F10.1.454.CMB.2.raw
  modified_base (195)..(195): a, c, t, g, unknown or other
  misc_feature (195)..(195): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagctaacttagcctggtaccagcaagaacctggccacgccctcccaggcctcctcatctagtggtgcactcccgcgacgggccacgtggaactcccagcctaggttcacggtgactacggtgggtctgggacngtacgttcactcacaacatacgcacgcctgactagtctagaattattttagtaagttttnttcgtgtctgactagtacagttcgaggtcggaccgtagggtaccgttcggaaccgaaacgggaaccgtaagggtacgaaaactaccgaaaacggtacgtcggtacgctacgaacactacttctcgttctctacttccccg

SEQ ID NO: 346585 - DNA, 679 bp, Homo sapiens
  misc_feature: GZ8MTXP02GAES0.21.65.F10.1.454.CMB.2.raw
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtacccagcagaaacctggccagccctcccaggcctcctcatctatggtncatcccgcgagggccacgtggactcccagccaggttcaggtggcacgtggggtcgtggggacnggtacgttccaccttcctaccgaacctatccgaacgccgtaaccgcccgttacgaccgtagttaccgtaggttaaagttacgttttttaagttaaaaggtttttcttttacgttcggttccttaggtaccttaaggttaaacctaagttccgtaaggttccgggtacccggtttaccggggtaccggtttaccgggaacccggtaaaacggggtaacccgttaaaaggggttaacggggaaaacttaaccggaaaaccggttacgtcggtaggactaacggaccctacgtactcgtacgtttacttaccgttaacc

SEQ ID NO: 346586 - DNA, 589 bp, Homo sapiens
  misc_feature: GZ8MTXP02GJLPU.21.65.F10.1.454.CMB.2.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
  modified_base (356)..(356): a, c, t, g, unknown or other
  misc_feature (356)..(356): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagccctccaggcctcctnatctatggtgcatcccgcaggggccacgtggaactcccagccaggttcagtggccagtgggtctggggacnggagttcacttcctaccacatcagcacgccctgcagtctaggtaaattagttttagtaagttttactttcttgttctaggtactaagttaactaacgttcgaggttcggtcccgtacgggtaccgttccgggaccgtaaacggggaccgtaaaagggtacggaaaacgttaccgaaaacggtacgtggtacggacctaaggacctacgtacgttccgtagttccttacgtacc

SEQ ID NO: 346587 - DNA, 493 bp, Homo sapiens
  misc_feature: GZ8MTXP02F49O0.21.65.F10.1.454.CMB.2.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtaccagcagaacctggccagcctccaggctcctnatctatggtncatccgcgagggccagtggaactcccagccagtcagtgcacgtggtcngggacngattcactcctcacntcagcagcctagcagtctagtaagtatttagaagttttattctgtctgctagtacatcgagtcgcgtcggacgtcgacgaagacgaaggtagaaactacaaacgacngtgcngcacntactgtctctac

SEQ ID NO: 346588 - DNA, 533 bp, Homo sapiens
  misc_feature: GZ8MTXP02IMSHD.21.65.F10.1.454.CMB.2.raw
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagagcctggccagcctcccaggctcctcatctatggtncactccgccaggggcccacgtcggaactccccgagccctaggttccccagtggctacgtggggtcctggggacngtacgttccacttctacacatccagccagccgtgctagtctaggtaagttattttagtaagttttatttctgttctgactagtacaatcgagtcggctcggtacgtcgacgaacgggacaaggtagtaaacacgaaagactgtagctcgacacatccgtagtcttc

SEQ ID NO: 346589 - DNA, 619 bp, Homo sapiens
  misc_feature: GZ8MTXP02ISBE8.21.65.F10.1.454.CMB.2.raw
  modified_base (376)..(376): a, c, t, g, unknown or other
  misc_feature (376)..(376): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaaacctggaccacgccctcccgaggcctcctcatctagtggtgcactcccgcgacgggcccacgtggaactccccgagcccgtaggttcaggtcggctacgtggggtctggggacnggtacgttccactctccacatcagcacgcctgactagtctagtaagttattttagtaagttttatttcgtgttactacgtctaacgttactaaacttcgaggttccggtaccgttccgggaccggtttaccgggaccgaaacggggtaaccgtaaaggggtaacggtaaacgttaaccgaaaacgtacgttagggtcgtacgtaacgacctaaccgtacgtccgttacgttccttacttaccg

SEQ ID NO: 346590 - DNA, 617 bp, Homo sapiens
  misc_feature: GZ8MTXP02G2FQ7.21.65.F10.1.454.CMB.2.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctaacctgcagggccagtcagagtgttagcagcaacttagcctggtacccagcaagaaacctggccagcctcccaggcctcctnatctatggtncatccgccagggccacgtggaactcccgagccgaggttcagtcggcagtggggtctagggacaggtacgttcacgttcctaccaacctatcacgcacgccctgcagttctggtaaagttgttttaggtaaagttttactttctgttctgtactaagttaccaaagttccgaggttcggtcccgttacgggaccggtttaccgggaccgaaaacggggtacccgaaaaggggttacggaaaaactaaccggtaaaacgtaacgtacggtacgggtactcggacctaaccgtacgttctacgttacctttaccttacccg

SEQ ID NO: 346591 - DNA, 524 bp, Homo sapiens
  misc_feature: GZ8MTXP02G5MNR.21.65.F10.1.454.CMB.2.raw
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
tcagtcgtcgctcgcacgaccggtgctcgatttagctacgctctaaggggggaggaactgctcagttaggacccagacggaaccatggaagccccagcgcagcttctattcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcaagaacctggccagccctcccaggcctcctcatctatggtncatcccgcagggccacgtggaactcccagccaggttcaggtcgctacgtggggtctaggggacnggcgttcacgtcctacacatcagcacgctgcagtcngaagtntttagtaagtttntttcgtgttctgtacagtacatcagtcgcctggacgtcgacgaaggacgaggtacgaaactacgaaaacgcgtagtcgactgacctaacactcgtgtccttatacc

SEQ ID NO: 346592 - DNA, 567 bp, Homo sapiens
  misc_feature: GZ8MTXP02HWYHC.21.65.F10.1.454.CMB.2.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggagaaatagtgatgacgcagtctccagccaccctgtctgtgtctccgagggganagagcccaccctctcctgcagggccagtcagagtgtagcagcaacttgcctggtaccagcagaaacctggccagccctccagcctccncatctatggncatcccgcagggccagtggaactcccagcccaggttcaggtgccagtggggtctggggacnggtcgttccacttcctcaccatccagcacgtcctgcagtctagaatagttttagtaagtttatttctggttctggtacagttacaagtccgaggtcggtaccgtcgggtacgttaccggaccgaaaacggggtaccgtaaacgggtaggtaaactaacggaaaacgtacgttaggacggtctgcctaactcgtcctcgttacctttcgtacc

SEQ ID NO: 346593 - DNA, 679 bp, Homo sapiens
  misc_feature: GZ8MTXP02JEVJ4.21.65.F10.1.454.CMB.2.raw
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaaacctggccagccctcccaggcctctcatctagtggtgcactccgccgagggccacgtggaactccccgagcctaggttcaggtcgctacgtggggtctaggggacnggtcgttacacttccnccaactatccagcctacgcccgtgacctagtctaggaaagtttatttttggtaaaagtttttnttttccnggtttacctgtaccgtaagttaacctaaagtccgtaagggttcgggaaccccgttcgggggtaacccgtttaccggggaacccggtaaaacgggggtaaacccgtaaagggggtaaacggtaaaacgtaaacccggtaaaaaccgggtaaacgttggggtacgggtacctaacggaccccgtaaaaccttacgttccgtttaccggtttccctttaccgttaaccg

SEQ ID NO: 346594 - DNA, 496 bp, Homo sapiens
  misc_feature: GZ8MTXP02GS4KR.21.65.F10.1.454.CMB.2.raw
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
  modified_base (406)..(406): a, c, t, g, unknown or other
  misc_feature (406)..(406): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcaagaaacctggccagcctcccaggcctcctcatctatggtncatccgcagggccatggaactcccagccaggttcagtggcacgtggggtctggggacnggattcactctcaccatcagcagcctgcagtcngaagtattttgaaagtttnttctgtctgcagtacatcagtcgcctggacgtcgcgaaggaccaaggtgaaactcaaaacgtacgtcgtgctgcaccatctcgtctctac

SEQ ID NO: 346595 - DNA, 636 bp, Homo sapiens
  misc_feature: GZ8MTXP02H7I7X.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagagccaccctctcctgcagggccagtcagagtgttagcagcaacttgcgtaggtaccaaacacgaaacctggacccagccctacccgaggcctcctcatctagtggtgcatcccgcgacgggcccacgtggaactcccgagccgtaaggttcaggtcgcacgtgggctgggacagtcgttcactctacacatcagcctagcctgactagtctaggtaattagttttagaagtttttattcgtagttctacgtacgtaagttaacaagttcgtaagggttccggacccgttacggggtaccggtttaccgggaaacccgtaaagggggaaacccgttaaggggtaaaacggtaaataaaaccgtaaaacggtaaaccgttggtacgggtacctacggtaaccaacgtacgtttcgtaacgttccttaccttactttcccccg

SEQ ID NO: 346596 - DNA, 514 bp, Homo sapiens
  misc_feature: GZ8MTXP02HVOJK.21.65.F10.1.454.CMB.2.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgtagcagcaacttagcctggtaccagcagaaacctggccagcctcccaggctcctnatctatggtncatccgcaggccagtgaactcccagccaggtcagtgcagtgggctgggacngngttcactctacacatcagcagcctgcagtctagaagttatttagagttttattcgtgtctagctaagtacaatcagtcggcctgggtacgtcggacgaaggtaccgaaaggtcgaaaactcgaaaacgtacgtggtagctgactaaccgtatcgtacgtcttactc

SEQ ID NO: 346597 - DNA, 789 bp, Homo sapiens
  misc_feature: GZ8MTXP02F3X2Q.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgcccacctctcctgcgagggccagtcgagtagtgttagcagctaacgttacgccgtaggtaaccagcaacgaaaccgtcggaccacgccctaccgacggccctcctacacttccgtagtcggtcacctacgtccccggaccgacggggtaccaacgttcggaaaccttccccgacggtaccgtaagggttccgaacgggtcggaccgtacggggttcggggtaccgtacggggactacggggtaccgttacccaaccgtttcccaaccgaacctagtaccgaacgtcccgacggtccctaggaccgtaagttacgtaagggttaaactttagtttttaaggttaaagtttttactttacgttcgttacgttacgtactaacgttaaactaacgttaccggagggttacccggtacccgggttaacgggtaccgggtttaaccggggaccggttaaaacggggaacgggttaaaacggggtaacggtaaaacgtaaaccggtaaaaacggtccgttacgggtaccggtaacctaaccggtaacgttaacccctaacgttccgtttaccggttaccctttaccgttaaccccg

SEQ ID NO: 346598 - DNA, 640 bp, Homo sapiens
  misc_feature: GZ8MTXP02HY4GQ.21.65.F10.1.454.CMB.2.raw
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagcccaccctgtctgtgtctccgaggggagagacgcccaccctctcctgcagggccagtcagagtgttagcagctaacttagcctaggtaccagacaacgaaacctggccacgccctcccgaggcctcctnatctagtggtncactcccgccgaggggcccacgtcggaactcccccgaagtccgtaagggttcaacggttcggacctacggttgggggtctacggggaactagggtacgtttccaaccttcctaccaacccatccgagccacggtcctacggcctagttcgtagtaaagttagttttaggtaagtttttatttcgttgttctagtactagtaacatcgtaggtcggtccgtcggtacgttcgggaccgtaaacgggtaccgaaggggtagtaaacgtaaccgaaaacgtacgtaggtacgcgtaacgacgtaacctcgtacgttcgttacctttactaccc

SEQ ID NO: 346599 - DNA, 756 bp, Homo sapiens
  misc_feature: GZ8MTXP02IN5MC.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggaagaaatagtgatgacgcagtctccagccacctgtctgtgtctccgaggggagagacgcccaccctctcctgcgacgggccagtcagagttgttagcagactaacttacgccgtacggtaacccagacaaacgaaacccgtcggaccacgcccctacccgaggtccctcctcacttctagtcgggtcacctaccgtcccggaccggacgggccctacggtacggaacctccccgaacgccgtaaggttccgaggtcggacctacggttcggggtacgtacggggaactaggttacgtttacccaaccttcctacccaaccgtactaccgagtccgaccgttcccgagccgtaacgttcgtaaaggttaagttttagtttttaaggttaactttttcgtttaccgttggtttctacgtacgttaacgttactaaacgtccggtaacgttccgggtacccgttaacgggggttaccggttaccgggaaaccgggaaacgggtaaaaccggtaaagggttaaacgtaaaaccgtaaacgaaaacccggtagttacggtacggaccgtaacgaccctaacttcgttaccgtttacgtttaccgtttacgttaacccg

SEQ ID NO: 346600 - DNA, 561 bp, Homo sapiens
  misc_feature: GZ8MTXP02G8Q7S.21.65.F10.1.454.CMB.2.raw
  modified_base (194)..(194): a, c, t, g, unknown or other
  misc_feature (194)..(194): n is a, c, g, or t
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccagggganagagccactctctcctgcagggccagtcagagtgttagcagcaacttgcctggtaccagcagaaacctggccagccctcccaggcctcctcatctatggtncatccgcgacgggccacgtggaactcccagcctaggtcagtcggacacgtgggtcgtgggacaggagttcacttcncaccatcagcagcctgcagtctagaaagttagttttagtaagttttattctgtctggtacaagttacaatcgtaaggtcggcccgtcgggacgttcggaccgaaagggaacccgaaagggttagaaaaacgtacgaaaacgaacgttaggcgggactcggacaaccctagtctacgtacctttctaaccg

SEQ ID NO: 346601 - DNA, 547 bp, Homo sapiens
  misc_feature: GZ8MTXP02FYPX4.21.65.F10.1.454.CMB.2.raw
  modified_base (295)..(295): a, c, t, g, unknown or other
  misc_feature (295)..(295): n is a, c, g, or t
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgttagcagcaacttagcctggaccagcaagaacctggccagcctcccaggcctcctcatctatggtncactccgccgaggggcctacgtcggaactccccagcctaggttcagtcggcacgtggggtcnggggacagtacgttcacttccacaaccatcagcagcctgccagttcagtaaagtatttttagaaatttttnttctgttactgactagtacagtcgagtcggcgtcggacgtcgaacgaaggacgtaaaggtacgaaaactaacgtaaacgacgtcgtggactaacgacactacttcgtcttactactacg

SEQ ID NO: 346602 - DNA, 828 bp, Homo sapiens
  misc_feature: GZ8MTXP02HHU64.21.65.F10.1.454.CMB.2.raw
  modified_base (304)..(304): a, c, t, g, unknown or other
  misc_feature (304)..(304): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcaagaaacctggacccacgccctcccaggcctcctcatctatggtncactcccgccgagggcccacgtcggaactccccgaaggccctaggttccacggtgggacctacggttcggggtacgtcggggaactagggtaacgtttccaaccgttcctaccaaccccgtaagtcccgaaacggtcccaacggtcccccttaggcccgttaaaacgggttccgttaaacgggtaaaacggtttttacgtttttttaaacgggttaaaagttttttttaacctttttaccgttcgggttttaccttacgggtttaacctaaacgggtttaaaccctaaaaggtttcccgtaaaggggtttccggggtacccccggtttaccgggggtaacccgggtttttacccgggggaaaacccccgggttaaaacgggggtaaaacccggtaaaagggggtttaaacgggaaaaaccgttaaaccggaaaacccgggttaaacggtacggggttcgggtaacctaacgggaccgtaaacccgttacttaccgtttccggtttaccctttacctttaacccg

SEQ ID NO: 346603 - DNA, 558 bp, Homo sapiens
  misc_feature: GZ8MTXP02FJ0VX.21.65.F10.1.454.CMB.2.raw
  modified_base (296)..(296): a, c, t, g, unknown or other
  misc_feature (296)..(296): n is a, c, g, or t
  modified_base (392)..(392): a, c, t, g, unknown or other
  misc_feature (392)..(392): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagcccaccctctcctgcagggccagtcagagtgttagcagcaacttagcctggtaccagcagaaacctggccagccctcccaggctcctcatctatggtncatccgccaggggccacgtggaactcccagccaggttcagtggcacgtggggtctggggacaggagttcactctcaccatcagcagcctgcagtcngtaagtattttggaaagtttatttcgtagttcgtgctagtacaatccgaggtggaccgtcggggtacgtttccgggaccgaaacggggaacccgaaagggttacggaaaactacgaaaacggtaacgtaggtggactcggacaccgtatcctgtaccttacgtacg

SEQ ID NO: 346604 - DNA, 534 bp, Homo sapiens
  misc_feature: GZ8MTXP02FSLIP.21.65.F10.1.454.CMB.2.raw
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (525)..(525): a, c, t, g, unknown or other
  misc_feature (525)..(525): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagagccaccctctcctgccagggccagtcagagtgttagcagcaacttgcctggtaccagcagaaacctggccagcctcccaggcctcctcatctagtggtgcatccggccagggccacgtggaactcccagccaggttcaggtcgcacgtgggtcnggggacagtgtcactctcaccancagcagcctgcagtcagaatnttttagaagtttnttctgtctgcagtacatcgagtcgctcggtacgttcggaccgtaaaggggacccaagggtacgaaagtaaccgaaaacggaactggtaacgcgtagcctacgacttctgtcttacnctttccccg

SEQ ID NO: 346605 - DNA, 534 bp, Homo sapiens
  misc_feature: GZ8MTXP02GTLAA.21.65.F10.1.454.CMB.2.raw
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
  modified_base (509)..(509): a, c, t, g, unknown or other
  misc_feature (509)..(509): n is a, c, g, or t
  modified_base (520)..(520): a, c, t, g, unknown or other
  misc_feature (520)..(520): n is a, c, g, or t
  modified_base (533)..(533): a, c, t, g, unknown or other
  misc_feature (533)..(533): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaacctggccacgccctcccaggcctcctcatctatggtncatccgacagggccagtgaactcccagccaggttcagtggctacgtgggtctgggacnggtagttcactctaccaaccatccagccagccctgacagtcagtaagtntttagaatttctttcngtctgctaagtacaatcgaagtcggcctcggtacgtcggaccgaagggtaaccaagggtagaaataccgaaaacgtgtacgtggtacngaccaaccttntcgtctccttacnc

SEQ ID NO: 346606 - DNA, 611 bp, Homo sapiens
  misc_feature: GZ8MTXP02IRAEX.21.65.F10.1.454.CMB.2.raw
  modified_base (293)..(293): a, c, t, g, unknown or other
  misc_feature (293)..(293): n is a, c, g, or t
  modified_base (363)..(363): a, c, t, g, unknown or other
  misc_feature (363)..(363): n is a, c, g, or t
  modified_base (431)..(431): a, c, t, g, unknown or other
  misc_feature (431)..(431): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttgcctggtaccagcagaacctggccagcctccaggctcctcatctatggtncatcccgcagggcccacgtggaactcccagccgaggttcaggtcggcctacggtggggtcgtaggggacnggtacgttcaccgtcctaccacatcagcagtcctgactagtctagaaacttagttttacgaagttttntttacgtggttctgtactaagtaccaagtcgagtcggaccgttacgggtaccgttcgggaccgaaacggggtaaccgtaaaggggtaacgtaaaacgtaaccgaaaacggtaacgttacgggtacggtaccgttcggaacctaacccgtacgttccgttacgttcctttaaccttacccg

SEQ ID NO: 346607 - DNA, 561 bp, Homo sapiens
  misc_feature: GZ8MTXP02J0SQU.21.65.F10.1.454.CMB.2.raw
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgtagcagcaacttagcctggtaccagcaagaacctggccacgccctcccaggcctcctcatctatcggtgcatcccgccagggcccagtcggaactcccgagccctaggttcaggtcgcacgtggggtctggggacnggacgttcaccgtctccaacntcacgcacgccctgcagtcagagtntttagtaagttttnttctgtctgtctagtacaatcaggttcggccgtcggtacgttcggaccgaaagggtaccgaagggtagaaacgtacgaaacggtaacctggtacggtactaacgacccaaaccgtacttacgtcgttccttactacc

SEQ ID NO: 346608 - DNA, 609 bp, Homo sapiens
  misc_feature: GZ8MTXP02HMQ1M.21.65.F10.1.454.CMB.2.raw
  modified_base (194)..(194): a, c, t, g, unknown or other
  misc_feature (194)..(194): n is a, c, g, or t
  modified_base (298)..(298): a, c, t, g, unknown or other
  misc_feature (298)..(298): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaattagcctggtaccagcaagaaacctggccagccctcccgaggcctcctcatctatgggtncatcccgcagggccactggaatcccagccaggttcagtgcagtgggtctggggacnggagttcacgttcctcaccagtcagctagcctgctagtctagtaatatttttaggaatttttattcttagtttctggtactaaggttaacctaaattccgaaggttgggtcccccgttacgggggtaacccggttttccggggaacccgtaaaacgggggtaacccgtaaaaggggttacgggaaaacttaaccgaaaacgtacgtaggttacggcttaacggccaaccgtacttctacggttacctttcacccg

SEQ ID NO: 346609 - DNA, 572 bp, Homo sapiens
  misc_feature: GZ8MTXP02I5WQQ.21.65.F10.1.454.CMB.2.raw
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggcctcctcatctatggtncatcccgccagggcccacgtggaactccccgagccaggttcagtcggcacgtgggtctgggacagngttcactctcacctatcagcagcctgctagtctagaagtnttttagaagtttattctagtctgactagtactaatcgagtggtcctcgggtaacggtttccggaccgaaaagggggaccctaaaaggggtacggtaaaataccgaaaacggtaacgtggtacgggactacggaaccaacgtacttcgtcgttacctttacacgtttccccg

SEQ ID NO: 346610 - DNA, 522 bp, Homo sapiens
  misc_feature: GZ8MTXP02FPBO2.21.65.F10.1.454.CMB.2.raw
  modified_base (499)..(499): a, c, t, g, unknown or other
  misc_feature (499)..(499): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctccaggcctcctcatctatggtgcactcccgccagggcccacgtggaactcccgagccaggttccaggtcggcacgtgggtctgggacaggtgtcactctaccaccatcagcagccctgctagtctagaagttattttagtaagttttattctgtctgctagtacaatcgagtcggcctggtacgtcggacgagggacaggtacgaaatacgaaacgactggacgtcncgcacatctgtctctacttcccg

SEQ ID NO: 346611 - DNA, 551 bp, Homo sapiens
  misc_feature: GZ8MTXP02JRHZE.21.65.F10.1.454.CMB.2.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcagaacctggccagcctcccaggctcctnatctatggtncatccgcgagggccacgtggaactcccagccaggttcaggtggctacgtggggtctggggacngtacgttcacgtctcaccatcagtcagcctagcagtctagaatattttagaatttnttctgttctgtacagtacaatcgaggtcgctacggtacgttcggaccgaagggtaccgaaaggtaggaaaactacgaaaaccggtatcggtacggaccgtaaggaccctaactacgtacgtttacgtcctacgtaccg

SEQ ID NO: 346612 - DNA, 552 bp, Homo sapiens
  misc_feature: GZ8MTXP02GUSHH.21.65.F10.1.454.CMB.2.raw
  modified_base (357)..(357): a, c, t, g, unknown or other
  misc_feature (357)..(357): n is a, c, g, or t
  modified_base (435)..(435): a, c, t, g, unknown or other
  misc_feature (435)..(435): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggcctcctcatctatggtgcatccgccaggggcccagtggaactcccagcccaggttccagtgcacgtgggtctggggacngtagttcactctaccaccatccagcacgccctgccagtctagtaagtattttgaagttttatttctgtctgctagtanaatcgagtcggcctgggtaccgttcgggacccgaaaggggacctaggggtacggtaaaactacgaaaacgtacgtggtacggacgtgacccaacctattcctggttacctttctacc

SEQ ID NO: 346613 - DNA, 604 bp, Homo sapiens
  misc_feature: GZ8MTXP02GY2W8.21.65.F10.1.454.CMB.2.raw
  modified_base (196)..(196): a, c, t, g, unknown or other
  misc_feature (196)..(196): n is a, c, g, or t
  modified_base (376)..(376): a, c, t, g, unknown or other
  misc_feature (376)..(376): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgtagcagcaacttgcctggtaccagcaagaacctggaccacgccctcccgagcctcctcatctagtggtcgctacgtcccggaccgaggggcccacgtcggaactccccgagcctaggttcaggtcgctacgtgggtcagggacnggtctcactcacacatcagcacgcctgcagtctagtaagttagttttagtaagtttatttcgtgttcgtgtacctagttaactaagtcgtaggttcggtaccgttacggggtaccgttacgggaaccgtaaacggggtaaccgtaagggtaacgaaacgtaaaccgaaaacggtacgtcggtacggtacgtaacgacctaaccgtattccgtacgtttccttactacc

SEQ ID NO: 346614 - DNA, 738 bp, Homo sapiens
  misc_feature: GZ8MTXP02FTFBW.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcgagggccagtcagagttgttagcagctaacgttagcctggtaccagcaacgaacctggaccagccctacccgaggtcctcctcatctagtggtcgcactcccgccgagggcccacgtaggaactccccgagccgtaggttcaggtcggcctacggtcggggtcgtaggggaactggtacgttccaccgttcctaccaaccagtccgaacgcctaacgcccgttagacctagtacgtaaggtaaagtttagtttttaggtaaaagtttttctttaccgttagttcgttacggtacttaaacgtttaaacctaagttaccgagggttacccgggggttccccgttacggggttaaccccgggttacccgggggaaacccggtaaaacgggggtaaaacccgtaaagggggttaaaccgggtaaaaacttaaaccgggaaaaaccggttaacgtcggggtaaccggtaccgttaacgacccctaaccgttagttaccccgtttggtacccctttaccttaaccccg

SEQ ID NO: 346615 - DNA, 488 bp, Homo sapiens
  misc_feature: GZ8MTXP02GCSL6.21.65.F10.1.454.CMB.2.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccacctctcctgcagggccagtcagagtgttagcagcaacttagcctggtaccagcagaaacctggccagcctccaggcctcctcatctatggtncatccgcagggccactggaactcccagccaggttcagtgcacgtgggtctggggacngagttcactctcacatcagcagcctgcagtcagaagtattttgaaagtttactttctgtctgctagtacaatcagtcgctggacttcgccaaggacagtagaaactcaaacgactgtgctgcaccatctatcttacac

SEQ ID NO: 346616 - DNA, 565 bp, Homo sapiens
  misc_feature: GZ8MTXP02J2HJI.21.65.F10.1.454.CMB.2.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccaccctctcctgcagggccagtcagagtgtagcagcaacttgcctggtaccagcagaacctggccagcctcccaggcctcctcatctatggtncatcccgccagggcccatggaactcccagccaggttcagtggcacgtgggtcnggggacnggagttcactctcacatcagcagccctgcagtctagaagtntttttagaagttttatttcgtgttcngtctaagtactaagtcgtaggtcggccgttacggtaccggttacggaccgaaacggggtaccggtaggggtaacggaaaacgtacgaaaacggacgtcgggtacggtacgtcgacccaacgtacttccgtcgtaccttactacg

SEQ ID NO: 346617 - DNA, 684 bp, Homo sapiens
  misc_feature: GZ8MTXP02JGWD1.21.65.F10.1.454.CMB.2.raw
  modified_base (194)..(194): a, c, t, g, unknown or other
  misc_feature (194)..(194): n is a, c, g, or t
  modified_base (298)..(298): a, c, t, g, unknown or other
  misc_feature (298)..(298): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaaacctggccagccctcccaggcctcctcatctatgggtcncacgtccgccgacgggcctacgtacggacctcccgacgccgtaggttcacggtcggcgtacggtcggggtcgtacggggactggtacgttcctaccttcctaccaacctatacgacgaccacgccgtacggactacgttacgtaaggtaaaggttttaacgtttttaggttaaagtttttactttcgttcgttacttacgtaacgtaacgttacctaagttaccgtaggtccggttaccgtacgggtacccggttaccgggaaccggaaacggggtaaccggtaaaggggttaaacggtaaaacgtaacgggtaaaacggtacgttcgggtaccggaccgtaaccggacctaaccgttacgttcgtttacgttaccttaccgtacg

SEQ ID NO: 346618 - DNA, 734 bp, Homo sapiens
  misc_feature: GZ8MTXP02FIMKV.21.65.F10.1.454.CMB.2.raw
  modified_base (700)..(700): a, c, t, g, unknown or other
  misc_feature (700)..(700): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggggagagacgcccacctcctctgacggacggacctagtacgaaggtaggttagttacgacgacgaacctaacgttacgtccgttacggaaccacgacgaaaccgtaaccgcggaccaccgtcccctaccgacgtcctcctactacttactagtggtcactaccgtcccgacggacggacctacggtacgaccctacccgacgacgttacggttacgacggtcgaccgtagggttcgggtcggtacggacgtacggtacgtacctacttccacctaactactacgacgcgtaaccgtccgtacgacgtacgttacgtaaaggttaagtttttagttttaaggtttaaatttttcctttacggtcgtttacgtacggaactttaacggttaaactacgttacgggtacgggttccgtacccggttacggggtaccgttaccggggaaaccggaaacgggtaaccgtaaaggggtaagtaaaacctaaacggaaaacgtcggtggacggtanaaccgactacttacgtcgttcttcctactacccg

SEQ ID NO: 346619 - DNA, 614 bp, Homo sapiens
  misc_feature: GZ8MTXP02FST6J.21.65.F10.1.454.CMB.2.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
  modified_base (346)..(346): a, c, t, g, unknown or other
  misc_feature (346)..(346): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttgcctggtaccagcagaacctggccagcctccagcctcctcatctatgtncatccgcagggccacgtgaactcccagccaggttcagtgcagtgggtctgggacngacgttccactctacaacatcagcacgccctgacctagtctaggtaaagttatttttagaaagttttctttcgtacgttctgtactaacggttaaccaaagttccgtaggttcggcccgtttacggggaccgttaccggggacccgtaaaacggggtaacccgtaaaaggggtaacggtaaaactaaccggaaaacgtaaccgttaggtacgggtacctaacggtaacccaacccgttagttccgtttacgtccctttacgttaaccc

SEQ ID NO: 346620 - DNA, 602 bp, Homo sapiens
  misc_feature: GZ8MTXP02G98KM.21.65.F10.1.454.CMB.2.raw
  modified_base (382)..(382): a, c, t, g, unknown or other
  misc_feature (382)..(382): n is a, c, g, or t
  modified_base (447)..(447): a, c, t, g, unknown or other
  misc_feature (447)..(447): n is a, c, g, or t
  modified_base (567)..(567): a, c, t, g, unknown or other
  misc_feature (567)..(567): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcagaacctggccagccctcccaggcctcctcatctagtcggtcgcacgtcccgccgacggggcccacgtggaactccccgaagccgtaggttcacggtcggcctacggtggggtctaggggacnggtacgttcactctccacatcagcacgcctagcagtactggtaagttattttaggtaaatttttnttacgttgttcgtagtacgtagttaacctaagtccgtaggttccggtaccgttcgggtaccggttaccgggaacgaaacggggtaccgtaaagggtacggaaaactacgaaaacgtacgnggtacggactcgtacacctactcgtcgttctctac

SEQ ID NO: 346621 - DNA, 667 bp, Homo sapiens
  misc_feature: GZ8MTXP02HR2XT.21.65.F10.1.454.CMB.2.raw
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgccacccctctcctgcagggccagtcagagtgttagcagactaacttgcctggtaacccagacaacgaaacctggacccacgccctcccaggcctcctnatctagtgggtnctactcccgcgacgggccacgtaggaactcccgagccgaggttcacggtcgaccgtaggtcggggtacgtaggggaactggtacgttaccaccttcctacacccaatccgaagccacggcctagcaagttctaagtaaagtttagttttaggtaattttattcgttgttaccgttagtacctaagttaacaaacgttcgaacggggtttccgaacccggttcggggtaacccggtttccgggaaaaccggtaaaaccggggaaccgtaaaaggggttaacggaaaaacttaacgggaaaaccgttagtcggttacggacgtaacgactaaccgtagttcgtcgttactttactaccc

SEQ ID NO: 346622 - DNA, 613 bp, Homo sapiens
  misc_feature: GZ8MTXP02G6GDZ.21.65.F10.1.454.CMB.2.raw
  modified_base (196)..(196): a, c, t, g, unknown or other
  misc_feature (196)..(196): n is a, c, g, or t
  modified_base (585)..(585): a, c, t, g, unknown or other
  misc_feature (585)..(585): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagtagtgttagcagctaacttagccgtaggtaccagacaacgaacctggaccacgcccctacccgaggccctcctcattctagtggtcgcctacgtccccggacgacgggccctacggtacggaactcccccgagtccgtaggttcacggtcggcctacggtgggtcgtgggactaggtcgttcacttcaccacatcagcacgccctgctagtctaggtattagttttagtaagtttttcttcttgtcttgtactaagttactaactcgtacggtcggtaccgtcgggtaaccgttaccgaaacggaacggggtaaacctagggtaagaaactacggaaaacgtacggtagacggtacncgactacgtacttcgtactcttactacc

SEQ ID NO: 346623 - DNA, 662 bp, Homo sapiens
  misc_feature: GZ8MTXP02HF57W.21.65.F10.1.454.CMB.2.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (452)..(452): a, c, t, g, unknown or other
  misc_feature (452)..(452): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggganagcgccacctctcgngcgcggcagcgagtgtagtacgnacgactacgtcgcgtcgacngacgaacgtacgcgacnccgtccctccggacgtcctccactactacgtagtggtcacaccgtcccgacggacggccacggtacgacctccgacgtccggtacgttcgacgggtcgacgtacgggtcgggtcggacgggaactcggttacgtacctaccgtacctaccaaccgtacgacgacgttccgaaccggttccncggacgttactacgttaaggtaaacgtttttgttttaaggttaaactttttctttcggtcgtttcgacttaagtaacgttatacgtcgtaggtccgtcgtacggttccggacggaacgaacgggtacgtaggtaaacgtaaactaacggaaaacctggtcggtcggactccggacctaacgttcgtacctcgttacccttaacttccccg

SEQ ID NO: 346624 - DNA, 516 bp, Homo sapiens
  misc_feature: GZ8MTXP02GH8Q2.21.65.F10.1.454.CMB.2.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccaccctgtctgtgtctccgagggganagagccacctctcctgcagggccagtcagagtgttagcagcaacttagcctggtaccagcagaaacctgccagcctccagcctctcatctatggtncatcccgcgacgggccacgtggaactcccgagccaggtcagtgcacgtggtctggacngacttcactctcacntcagcagcctgcagtcagtaagtagtttagaaagtttnttctgtctagtcaagtanaagtcagtcgtcgtcggacgtcgacgaaaggacctaaggagaaactacgaaacgacgtggtcgtacaacgacacgtactcgtactctactaccg

SEQ ID NO: 346625 - DNA, 518 bp, Homo sapiens
  misc_feature: GZ8MTXP02IP9YY.21.65.F10.1.454.CMB.2.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (279)..(279): a, c, t, g, unknown or other
  misc_feature (279)..(279): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
tcagtcgtcgctcgcacgaccggtgctcgatttagctacgctctaaggggaggaactgctcagttaggacccagacggaaccatggaagcccagcgcagcttctcttcctcctgctactctggcctccagaagctctggagaatgtgatgacgcagtctcagccacctgtcctgtgtctccaggggnagagccacctncctgcaggccagtcagatgtancagcaattgcctggtaccagcagaacctggccagcctcccaggcctctcatctatggtncagtccgctaggccactggaatcccagccagttcagtcgcacgtggtcnggacngngttcacttcnacatcagtcagctagctagtctgaatnttttagaacttttnttctcgttntcgtatagtactaacgtcgagtcgacgtcggtacgttacggacgaacggtacgtaagggtagaacgtaacgaacgtacgtacgtgacgtaacgacgtaacctacgtactacgttactactacg

SEQ ID NO: 346626 - DNA, 587 bp, Homo sapiens
  misc_feature: GZ8MTXP02FS66O.21.65.F10.1.454.CMB.2.raw
  modified_base (296)..(296): a, c, t, g, unknown or other
  misc_feature (296)..(296): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagagccaccctctcctgcagggccagtcagagtgttagcagcaacttagcctggtaccagcagaaacctggccagcctcccaggcctcctcatctatggtncatcccgcagggccagtggaactcccagccaggttcaggtcggcacgtgggtctggggacaggcgttcactcctccaccatcagcagccctgcctagtctagaagttatttttaggtaagttttattcttggttctggtactaagtactaacgtcgaggtcggtaccgtcgggtaccgttcggaaccgtaaacggggaaccgtaaagggttaggaaaactaacgaaaaccggtaacgtggtacggcgttacgaaccgtacctacgttctacgtttactactactttccccg

SEQ ID NO: 346627 - DNA, 769 bp, Homo sapiens
  misc_feature: GZ8MTXP02JH58Y.21.65.F10.1.454.CMB.2.raw
  modified_base (327)..(327): a, c, t, g, unknown or other
  misc_feature (327)..(327): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgcccaccctctcctggcgagggccagtcagtagtgttagcagactaacttacgccgtaggtaccagacaacgaaaccgtggacccacgccctcccgacggtccctccgtacacttcgtagtcgggtacncctacgtccccggaccgacggggacccctacgtacggtaacctccccggacgtaccgtaagggttcaacgggtcggacctacggttcggggtacgtaggggaactacgggtacgttaccaccgttaccacctaaccgtactcccgaacgtccaacggtccctaggacccgtaagttacgtaaggttaaagttttaagtttttaaggttaacgtttttacttttacggttcgttacgtttacggaacttacgttaaacgtaagtacggtacgggttaccggtacccggttacgggttaacccgggttaccgggaaacccggaaaacgggtaacgggtaaaacgggtacggtaaaaaccgtaaacggtaaaccgtaacggttacggtacggacctaacggtacctaaccgttacggttctttaccggttaccttccttaacccg

SEQ ID NO: 346628 - DNA, 491 bp, Homo sapiens
  misc_feature: GZ8MTXP02IHTU4.21.65.F10.1.454.CMB.2.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (395)..(395): a, c, t, g, unknown or other
  misc_feature (395)..(395): n is a, c, g, or t
tcagtcgtcgctcgcacgaccggtgctcgatttagctacgctctaaggggaggaactgctcagttaggacccagacggaaccatggaagccccagcgcagcttctcttcctcctgctactctggctcccagaaagctctggagaaatagtgatgacgcagtctccagccacctgtctgtgtctccagggganagagccacctntcctgcagggccagtcagagtgttagcagcaacttgcctggtaccagcagaactggcagcctccaggctctcatctanggtncatccgcagggccactggaactcccagccaggttcagtggccacgtgggtctggggacagggattcactctcacatcagcagcctgcagtctagatatttcgaaagtttntttctgtctagctagttacaatcagtcgcttcggacttgcaaggaccaggtagaaactacaaacgactcgtagctaagcacatctacgtcttacag

SEQ ID NO: 346629 - DNA, 514 bp, Homo sapiens
  misc_feature: GZ8MTXP02GFCAM.21.65.F10.1.454.CMB.2.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtacccagcaagaaacctggccagccctcccaggcctcctcatctatggtncatcccgcagggccagtggaactcccagccaggttcagtggcagtgggtctgggacnggnttcactctcaccatcagcagcctgcagtcagaagtattttgaagttttnttcgtgtctgctagtacaatcagtcgctcggacttcggacgaagggaccaaaggtggaaactacgaaaacgtaacgtgtggctgacaccatcctgtccttcacg

SEQ ID NO: 346630 - DNA, 673 bp, Homo sapiens
  misc_feature: GZ8MTXP02IOEJK.21.65.F10.1.454.CMB.2.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagcccaccctgtctgtgtctccgagggganagacgcccaccctctcctgcgagggccagtcagagtgttagcagctaacttagcctggtaccagacaacgaaacctggacccagccctacccaggcctcctnatctagtggtcncacgtcccgcgacgggccctaacgtcggaactccccgagtccgtaggttcacggtcggacctacggttgggtcgtaggggactaggtacgttccactcctaccacactcaacgcacgcctagaccgtagtacgtaggtaagttatttttagggtaaacgtttttactttcgttaggtttccgttacggtaccttaaagttacctaaagttcgtaacggttcgggtacccggttacgggttaccggttaccggggaacccgtaaaaccgggggtaccgtaaaaggggtacggtaaaactaaacccgaaaacggttacgtggtacgcgtaacgactaccgtattacgtcgtttaccttactaccg

SEQ ID NO: 346631 - DNA, 556 bp, Homo sapiens
  misc_feature: GZ8MTXP02JCJT3.21.65.F10.1.454.CMB.2.raw
  modified_base (195)..(195): a, c, t, g, unknown or other
  misc_feature (195)..(195): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (552)..(552): a, c, t, g, unknown or other
  misc_feature (552)..(552): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcaagaaccnggccacgccctcccaggcctcctcatctagtggtncactcccgccgagggcccagtggaactccccagccaggttcaggtcgcacgtggggtcnggggacnggtcgttcacctcncacctntcagcacgcctggcagtactagtaagttagtttttagtaagttttatttcgtgttactgtactagttaacagtcgaggtcggccgtcggtacgtcggacgaagggtacctaagggtaggaaactacgaaacgtcgtaggtcgatcgactacctatcctgttcttacncccg

SEQ ID NO: 346632 - DNA, 654 bp, Homo sapiens
  misc_feature: GZ8MTXP02HOXT8.21.65.F10.1.454.CMB.2.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaattagcctggtaccagcagaacctggccagccctccaggctcctcatctatggtncactcccgccagggccacgtggaactcccagccaggttcagtggcacgtggggtctaggggactggtacgttcaccgttcctacaccatccagccagccctgcagtctaggtaattagttttagtaagtttttatttcgttcgttcttcggaactaaggttaaaccaagttaccgtaagggttcgggaccccggttacggggttaacccggtttaccggggaacccggaaaacgggggtaacccgttaaaagggggttaacggaaaaaccgtttaaccggaaaaaccgttaaaccggttgggttacgggaccttaacggaccctaactacgttctttcggttaccctttacgttaccccg

SEQ ID NO: 346633 - DNA, 540 bp, Homo sapiens
  misc_feature: GZ8MTXP02GKIO9.21.65.F10.1.454.CMB.2.raw
  modified_base (295)..(295): a, c, t, g, unknown or other
  misc_feature (295)..(295): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (515)..(515): a, c, t, g, unknown or other
  misc_feature (515)..(515): n is a, c, g, or t
  modified_base (539)..(539): a, c, t, g, unknown or other
  misc_feature (539)..(539): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtncatcccgccaggggcccacgtggaactccccgagcctaggttcacggtcgctacggtgggtcgtagggactggtacgttcactcctacacatcagcacgtccngacngtcagtaagttatttagtagttttnttcgttgtctgatagtaacatacgaggtcgacgtcggtacgtcggacgaacgggacgtagggtaacgaacgaacgtaacgtacgtcgngacgcgacactctacgtctctacnc

SEQ ID NO: 346634 - DNA, 613 bp, Homo sapiens
  misc_feature: GZ8MTXP02GZPHN.21.65.F10.1.454.CMB.2.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcagaacctggccagcctccaggcctcctcatctatggtgcatcccgcagggcccagtggaactcccagtccaggttcacgtgcacgtgggtctggggacnggtcgttcacttccacaccatcgagcagcctgccngtctgaaagtntttttagaagttttactttcgtcgtttactggtcctaaggttaaactacgttaccgtaggttccgggcccgttacgggggtacccgtttacgggaccccgtaaaacgggggaccctaaaagggggtacgggtaaaactaccggaaaaacggtaccgtaaggttcggacgttaacggaccgaaccctattcccgtagtttacccttctaaccg

SEQ ID NO: 346635 - DNA, 693 bp, Homo sapiens
  misc_feature: GZ8MTXP02GW0S6.21.65.F10.1.454.CMB.2.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagctaacttagcctggtaccagcaagaacctggccagccctcccgagcctcctcatctagtggtcncactcccggaccgacggggccctacgtcggaacctccccgaagtccccgtaagggtttccaacgggtcggcctaacggtggggtacctaggggaactgggtacgtttccaccgttcctaccgacctatccacgcacgcctgactaggttactaggtaaagtttatttttaggtaaacgtttttctttacgttagtttaccttaggtacttaaacgtaacctaagtaccggtacggttcccgggtaccgttaccgggttaccggttacccgggaaccgggtaaaccggggtaaccgtaaaggggttaacgtaaaccgtaaaacgtaaacggtacgtgggtaccgtacgtaacgaccctaactcgttacgttacttacctaccgtttaccccg

SEQ ID NO: 346636 - DNA, 781 bp, Homo sapiens
  misc_feature: GZ8MTXP02FRU0B.21.65.F10.1.454.CMB.2.raw
  modified_base (309)..(309): a, c, t, g, unknown or other
  misc_feature (309)..(309): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagcccaccctgtctgtgtctccgaggggagagagcccaccctctcctgcagggccagtcagtagtgttagcagactaacttagcctggaccagcaagaaccgtggaccacgccctaccgaggtcctcctcatactagtggtcnccacgtcccggaccgaggggccccaacgtcggaacctccccgaagtcccgtaggggtttcaccggggttcgacctacggttggggtactggggaacctagggtacgttaccctaacttcccgtaccctaaccgtactacccgaaaccggtccgaaacccggtcccgtacgtaccgttaacggttacccgtaagggttaaaaggttttagttttttaagggtaaaacgtttttttacttttaccgttcgttaccgtacgggtaacttaacggttaaaacctaaacgttccgtaacggggttccggtaccccggttacgggggtaccccgggtttaaccgggaacccgggtaaaacgggggtaacccgttaaagggggttaaaccgaaaacgttaaaccggaaaacggttaacgttcggacgggtacctaaggtaaccctaccgtatttccttcggttaccttaccttaacccg

SEQ ID NO: 346637 - DNA, 564 bp, Homo sapiens
  misc_feature: GZ8MTXP02I56TR.21.65.F10.1.454.CMB.2.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (407)..(407): a, c, t, g, unknown or other
  misc_feature (407)..(407): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcagaacctggccagcctcccaggctctcatctanggtncatccgcagggccacgtggaactcccagccaggttcagtgcagtggtctgggacngtagttcacgtcncacntcagcagcctgctagtcagtaagttacttttagaacgttttnttacgtgttatgtactagtactaatcgagtcgggtacctagggtaccgttcggaccgaaggggaacccgtagggtacggaaaacttacgaaaaccggacgttagggtacggaccttaaggaccctaccggtactccgttacggttcctttctaaccg

SEQ ID NO: 346638 - DNA, 616 bp, Homo sapiens
  misc_feature: GZ8MTXP02IQB21.21.65.F10.1.454.CMB.2.raw
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgccacccctctcctgcagggccagtcagagtgtancagcaacttgcctggtaccagcaagaacctggaccacgccctcccgaggcctcctcactctagtggtcncactcccgcgacgggcccacgtaggactcccgagcctaggtcagtcggcacgtgggctaggggacaggtacgttcacgttctaccacgactcgaacgcacgccgtgcgtagttctaagtaaacgtttagtttagttaagttttactttcgtgttacgtgtacgtaacgtactaatcgtaggttcggtccgtacggtccgttaccgggacgtaaacggggtaccgtaaagggttaacggaaacttaaaccgaaaacggtaccgtaggtaccgtcgtaacgaccctaacgtacgtcttacgttacctttctaccg

SEQ ID NO: 346639 - DNA, 540 bp, Homo sapiens
  misc_feature: GZ8MTXP02FR3WS.21.65.F10.1.454.CMB.2.raw
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaaacctggccacgccctcccaggcctcctcatctagtggtcncactcccgcgagggcccacgtggaactcccagccaggttcagtgcacgtggtcnggacnggnttcactctcacatcagcagcctgacagtcagaagttntttagatttattctggtactgctagtacatcgagtcgccgttgcgtacgacgaacgggacgtaaggtacgaaactacgaaaacgtacgtaggtacggtcgaacgacacccgtattccgtacggttaccttacgttaaccg

SEQ ID NO: 346640 - DNA, 548 bp, Homo sapiens
  misc_feature: GZ8MTXP02G6AKT.21.65.F10.1.454.CMB.2.raw
  modified_base (297)..(297): a, c, t, g, unknown or other
  misc_feature (297)..(297): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccacccctctcctgcagggccagtcagagtgttagcagcaacttgcctggtaccagcagaacctggccagccctccaggcctcctcatctatggtncactccgccgagggcccacgtggaactcccgagccaggttcacgtgctacgtgggtcgtgggacaggtacgttcactctacaccatcagcacgcctgcagtcagtaagtattttagagtttattctgtctgtacagtacaatcgaggtcgaccgtcggtacgttcggacgaacgggtaccgaagggtagaaactacgaaacgtacgtcggtacggactaaggaccaacctatacgttcgtaccttctaccg

SEQ ID NO: 346641 - DNA, 680 bp, Homo sapiens
  misc_feature: GZ8MTXP02ITA3Y.21.65.F10.1.454.CMB.2.raw
  modified_base (302)..(302): a, c, t, g, unknown or other
  misc_feature (302)..(302): n is a, c, g, or t
  modified_base (505)..(505): a, c, t, g, unknown or other
  misc_feature (505)..(505): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagctaacttagcctggtaccagacagaaacctggccacgccctcccgaggcctcctcatctatggtnctactcccgcgacgggcccacgtcggaactcccgagccgaggttccacggtcggacctacggtcggggtcgtaggggaaccagtacgtttacacgttcctaccgacctatcgaacgcacgtccctgcctaagttcaggtaagttacgttttagtaagttttactttcgttgttacgtacgtactaacggttaacaaagttcgngggttccgggacccgttacgggggttaacccggtttaccggggaaccggtaaaacggggtaaaccgtaaagggggttaacggaaaaacgttaaccgaaaaacccggtaacgttacggtacggtaccgtaacggaaccaaccgtacttcggttacctttacctttaaccgtacccg

SEQ ID NO: 346642 - DNA, 635 bp, Homo sapiens
  misc_feature: GZ8MTXP02JH01X.21.65.F10.1.454.CMB.2.raw
  modified_base (304)..(304): a, c, t, g, unknown or other
  misc_feature (304)..(304): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccaccctctcctgcagggccagtcagagtgttagcagcaacttagcctggtaccagcaagaaacctggacccagccctcccgaggcctcctcactctatggtcncactcccgccgacgggccacgtggaactcccgagccgtaggttcagtcggccacgtggggtctaggggacaggtacgttccgacgttcctaccaacctactcgacgcctacgccctgactacgttacctagtaagttagtttttagtaagtttttactttcgttcggttcttacggtacgttaagttaactaaagtccgtaggttccgggtaccgttacggggtaccggttcgggaaccggtaacggggaaccgtaaagggtacggtaaaactacgaaaacgtacgtaggtacgacgtaacgacaaccgtacgttctacgttactactacc

SEQ ID NO: 346643 - DNA, 576 bp, Homo sapiens
  misc_feature: GZ8MTXP02JQ7L1.21.65.F10.1.454.CMB.2.raw
  modified_base (194)..(194): a, c, t, g, unknown or other
  misc_feature (194)..(194): n is a, c, g, or t
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (545)..(545): a, c, t, g, unknown or other
  misc_feature (545)..(545): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttgcctggtaccagcagaacctggccacgcctcccacggcctcctcatctatggtgcactccgccgacggccacgtggaactcccagccaggttcacgtcggctacgtcggggtcgtgggacngtacgttcacgtcncaccatcagcacgcctgctagtctaggaacgttattttagaagttttattcgtgttctagactaagtacaagttcgaggtcggccgtacgggtaaacggttccggaccgaaaagggggtaccgaaaaggggtaggaaaacttacgaaaacggtaccgtgggtcggtacnggtaccaaccgtatccgtcttccgtactacc

SEQ ID NO: 346644 - DNA, 534 bp, Homo sapiens
  misc_feature: GZ8MTXP02GRUQL.21.65.F10.1.454.CMB.2.raw
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (481)..(481): a, c, t, g, unknown or other
  misc_feature (481)..(481): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgaggggagagacgcccaccctctcctgcagggccagtcagagtgttagcagcaacttgcctggtaccagcaagaacctggccacgcctcccaggcctcctcatctatggtncactcccgccgacgggcccacgtcggaactcccgagcctaggtcaggtccgcagtgggtcngggacagtctcactcncaccatcancngcctgcagtcagaagttntttagtaagtttnttctgtctaggctaagtactagtctagtcgccgtcggtacgttcggacgaacggacaagggtanaaactcgaaacgacgtcggagtctagaacctactagtcgtcttactcacttcc

SEQ ID NO: 346645 - DNA, 524 bp, Homo sapiens
  misc_feature: GZ8MTXP02FHKXA.21.65.F10.1.454.CMB.2.raw
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (517)..(517): a, c, t, g, unknown or other
  misc_feature (517)..(517): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcagaaacctggccagcctcccaggcctcctcatctatggtncatccgccagggccactggaactcccaaacnggttcagtcggcacgtggggtctggggacaggtgtcactctcaccatccagcagccctgcagtctagaagtattttagagttttattctgtctgcagtacaatcagtggccctcgggacgttcggaccgaagggaaccaaggtaggaaatacgaaaacgactgtacgctagcactatcgtacgtctacngtttccc

SEQ ID NO: 346646 - DNA, 590 bp, Homo sapiens
  misc_feature: GZ8MTXP02JUEAP.21.65.F10.1.454.CMB.2.raw
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (417)..(417): a, c, t, g, unknown or other
  misc_feature (417)..(417): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaattagcctgtaccagcagaacctggccagcctccagcctcncatctatgtcncatccgcgagggccacgtgaactcccagcctaggttcaggtcgctacgtggggtctagggactgacgtttcgacctcgtaccacccatccacgccacggtccctgacctagttccttaggaaagtttnttttacggtaaagttttttctttcgttgtactgtaactagttaactagtcgtacggtcgtccgtacgggtaccgttacgggaaccggtaacgggtaacgtaagggtacgaaaactaccgaaacgtacgtcggacgactaacgacctacgtactccgttacgttccttactacc

SEQ ID NO: 346647 - DNA, 707 bp, Homo sapiens
  misc_feature: GZ8MTXP02IAWWK.21.65.F10.1.454.CMB.2.raw
  modified_base (298)..(298): a, c, t, g, unknown or other
  misc_feature (298)..(298): n is a, c, g, or t
tcagtcgtcgctcgcacgaccggtgctcgatttagctacgctctaagggggaggaactgctcagttaggacccagacggaaccatggtagccccagcgcagcttctcttcctcctgctactctggctcccagaaagctctggagaaatagtgatgacgcagtctccagccaccctgtctgtgtctccgagggagagagccacctctcctgcagggccagtcagagtgtagcagcaacttgcctggtaccagcaagaaacctcggccacgccctcccaggtcctcctcatcatgggtcncacgtcccgccgagggcccacgtggaactccccgaggcccgtaggttccaggttcggacctacggtcggggtcgtaggggactaggtacgtttccacgttcctaccgaccatccgacgcaccgtcccgtagccgtagttcttaagggtaaagtttaagttttttagggtaaaccgttttttattttccgtaggtttcctagggttacccttaagggttaaaccctaggttacccgtaaggggttccgggtaccccgttaacgggggtttcccgttacccgggggaaacccggttaaaacgggggaaccgtaaagggggttaaacggtaaaacttaaccggaaaaccggtaacggttggtaacgggccttggaccctaaacgtcgttcttacggtttcctttaacctccg

SEQ ID NO: 346648 - DNA, 617 bp, Homo sapiens
  misc_feature: GZ8MTXP02II21J.21.65.F10.1.454.CMB.2.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagcccaccctgtctgtgtctccgaggggagagagcccaccctctcctgcagggccagtcagagtgttagcagctaacttagcctggtaacccagcagaaaccnggccagccctcccaggcctcctcatctatggtncacgtcccgcgacgggccacgtggaactcccagccaggttcaggtggcagtggggtctggggacnggtacgttcactcctccactatcagcacgcctgctagtctaggtaagttattttagtaaagttttntttaccgtggttactcggtactaacgttactaaattccgtaaggttcgggtacccgttaccggggtaccggtttacccgggaaccggtaaaacggggaaacccgtaaaggggttacggaaaacgttaaccgaaaaacgtacgtaggtcggacgtaagaccactactacgtcttacttactacc

SEQ ID NO: 346649 - DNA, 593 bp, Homo sapiens
  misc_feature: GZ8MTXP02H6I5Z.21.65.F10.1.454.CMB.2.raw
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
  modified_base (387)..(388): a, c, t, g, unknown or other
  misc_feature (387)..(388): n is a, c, g, or t
  modified_base (393)..(393): a, c, t, g, unknown or other
  misc_feature (393)..(393): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagagcccacctctcctgcgagggccagtcagagtgttagcagctaacttgcctggtacagcagaacctggccagcctccaggcctccncatctagtggtncacgtccgacgacggggccagtggaactcccgagcccgaaggttcacggtggcctacggtcggggtcnggggacnggtacgtcactcncacnncagcngctgctagtctagtaacgttatttaggtatttactttcgtggtttacaggtactaagtactaagtcgaggtcggtccgtacgggtaccggttacgggaccgaaaacggggtaccgtaaagggttaacggaaaactaacggaaaacgtaacgtcggtcggactaacggcctaacgtacttcgtacgttcctttaacgtccg

SEQ ID NO: 346650 - DNA, 617 bp, Homo sapiens
  misc_feature: GZ8MTXP02JT9MJ.21.65.F10.1.454.CMB.2.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (424)..(424): a, c, t, g, unknown or other
  misc_feature (424)..(424): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccacccctctcctgcagggccagtcagagtgttagcagcaacttgcctggtaccagcagaaacctggccagcctcccaggcctcctnactctatggtncatcccgcagggcccagtggaactcccagcccaggttcagtgctacgtggggtctagggacnggacttcgacttccncacccatccgagcagcctagctagtctagtaagttattttagaaagttttntttcgtagttcgtacgactaacgtactaaacttcgaggttcggacccgttacgggtaccggtttccggggaacccgaaacgggggtaacccgtaaaggggttaccggaaaacgttaacccgaaaacggtaccgttacggtacggtactcggaccctaacctacgttccgtacgtttacctttaccgttacccg

SEQ ID NO: 346651 - DNA, 660 bp, Homo sapiens
  misc_feature: GZ8MTXP02H9QUU.21.65.F10.1.454.CMB.2.raw
  modified_base (300)..(300): a, c, t, g, unknown or other
  misc_feature (300)..(300): n is a, c, g, or t
  modified_base (427)..(427): a, c, t, g, unknown or other
  misc_feature (427)..(427): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgtatgacgcagtctccagccacctgtctgtgtctcgagggagagagccacctctcctgcgaggccagtcagagtgttagcagctaacttagcctggtaccagtcagaacctggaccagccctccgaggcctcctacactctagtgggtnacactcccggccgtaaggggccccaagttaggaaactcccccgaaaggccccgtaagggttccaagggtcgacgtaccgtggggtactggggacctggtacgtttcaccgttccgtacaacccgtanccacgcaacgccgtagaccgtagtacgtagtaaagtttagttttagtaacttttacttacttgttacgtagtactagtaactaacgtacgacggtcgtaccgtacggttaccgttaccggaaaccgtaaacgggtaaaccgtaaagggttacgaaaactaacgaaaaccggtacgttacggtaccgaccgtaaccgaccgtaaccgtacgttaccgttacgttccttacgacg

SEQ ID NO: 346652 - DNA, 605 bp, Homo sapiens
  misc_feature: GZ8MTXP02JGRD4.21.65.F10.1.454.CMB.2.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggggaaatagtgatgacgcagtctccagccaccctgtctgtgtctccgaggggagagacgcccaccctctcctgcagggccagtcagagtgtagcagcaattgcctggtaccagcagaacctggccagcctccaggcctccncatctatggtnctanccgccgagggccacgtcggaactcccgagccgtaggttcgagtcggactacgtggtcgtgggacagtcgttcactcgtacaccatccagcacgtcctgactagtctaggtaatttagttttagtaagttttacttcgttgtcttagactagtaactactcgtaggtcgtaccgtacgggtaccggttaccgggaccgtaaaacggggaccgtaaaagggtacggaaaactaaccggaaaacgttacgtggtacggactacgaacctaacgtacgttcgttacgttacctttaccactttacccccg

SEQ ID NO: 346653 - DNA, 805 bp, Homo sapiens
  misc_feature: GZ8MTXP02F4UG7.21.65.F10.1.454.CMB.2.raw
  modified_base (323)..(323): a, c, t, g, unknown or other
  misc_feature (323)..(323): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcgacggccagtcagagtgttagcagactaacttacgccgtaggtaccagacaacgaaaccgtcggaccacgcccctacccgacggcctcctacattctagtgggtacnctactccccggccgtaacggggcccctaacggtacggaaacctcccccgaaggtacccgtacgggtttcaacgggttcggaccgtacggttcggggtaccgtaggggaaccgtaggtacgttcccgtaacctcctacccaacctaatccgaacgccaacggtcctgacctaggttacaggttaaagtttagtttttacggaaaagttttttacgtttcgttacggtttcgttaacggtacttaaacggtttaaacctaaagtttcccggtaagggtttccgggtacccccggtttacgggggtacccggtttaacccgggggaaaccggaaaaacggggttaaaaccccggtaaaagggggttaaacgggtaaaaaccttaaacccggtaaaaacggggttaaccgttaggggttaccggaacggttaacggacccgtaaaccttacggttctttacgtttacccgtttacttaacccccgg

SEQ ID NO: 346654 - DNA, 570 bp, Homo sapiens
  misc_feature: GZ8MTXP02GWRLT.21.65.F10.1.454.CMB.2.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagcccaccctctcctgcagggccagtcagagtgttagcagcaacttagcctggtaccagcaagaaacctggccagccctcccaggcctcctcatctatggtgcactcccgcgagggccacgtggaactcccagccaggttcaggtgcacgtgggtctgggacnggtacgttcactcncacatcagcacgctgacagtctagaattagtttagtaagttttatttctgttctgtactagttaactaagtcgaggtcggtccgttacgggtacgttaccgggacgaaaacggggtacctaaaggggtacgaaaactacgaaaacggacgtacggtgtacgtaagacctaacgtactccgtacgttccttactaccg

SEQ ID NO: 346655 - DNA, 587 bp, Homo sapiens
  misc_feature: GZ8MTXP02GH3UJ.21.65.F10.1.454.CMB.2.raw
  modified_base (385)..(385): a, c, t, g, unknown or other
  misc_feature (385)..(385): n is a, c, g, or t
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcagggccagtcagagtgttagcagacaacttagcctggtaccagcagaacctgccacgccctcccgaggcctcctcatctagtggtcgctacgtcccgccgacgggcccacgtaggaacctccccgagccgtaggttcacggtcggcctacggtcggggtcgtaggggacnggtacgttcacgtcctacacatcagcacgctgactagtanaggtaagttagttttagtaattttnttcttagtctgtactagtaacaatctaggtcgtccgtcggtacgttacggaccgaacgggacgtaaaggtagaaactacgaaaacggtacgtaggtcgtacgtaacgaccaacgtacgtcgtacgttactactaccg

SEQ ID NO: 346656 - DNA, 602 bp, Homo sapiens
  misc_feature: GZ8MTXP02GA8AT.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccaccctctcctgcgagggccagtcagagtgtagcagcaacttagcctggaccagcaagaaacctggaccacgccctacccgaggtcctccctacactctaagtggtcacacgtccccggacgacgggccaacgtggaacctcccgagccgtaggttccaggtcgcctagtggggtctagggaactggtacgttcacgttccaccaacatcagcacgcctgctagtctaggtaaattagttttagtaaagttttctttacgtgtcttaggactaagttaacaatcgaggtcgccgttacgggcgtacgggacgaaacgggtacgaaagggtagaaactaacgaaaacggtacgttacggcggactaacggactacctacgtcgttacgttccttacgtaccc

SEQ ID NO: 346657 - DNA, 632 bp, Homo sapiens
  misc_feature: GZ8MTXP02IPOIK.21.65.F10.1.454.CMB.2.raw
  modified_base (307)..(307): a, c, t, g, unknown or other
  misc_feature (307)..(307): n is a, c, g, or t
  modified_base (421)..(421): a, c, t, g, unknown or other
  misc_feature (421)..(421): n is a, c, g, or t
  modified_base (484)..(484): a, c, t, g, unknown or other
  misc_feature (484)..(484): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggaagaaatagtgatgacgcagtctccagccacctgtctgtgtctccgaggggagagacgcccaccctctcctgcagggccagtcagtagtgttagcagactaacttagcctcggtaacagcaagaaacctggaccagccctccgagcctcctcactctagtggtcncactcccggccgtacggggcccacgtggaacctccccgagtccgtaggttcgacggtcggctacggtggggttcacggggaactagggtcttaccacgttccctacgaaacctnacgacggccaccgtccgtagacgtagttacgtaggttaagtttaacgttttagtaacgttttnttcgttgttcgtagtacgtaagtactacgtggtacggtcggtccgtacggtaccgtacggacggaacggtacggtaaaggtaagaaacgtaaacgaaacgtacgtcggtacgacgtaacgtacgtacttacgtcttacgttctactcg

SEQ ID NO: 346658 - DNA, 704 bp, Homo sapiens
  misc_feature: GZ8MTXP02F6GN8.21.65.F10.1.454.CMB.2.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (423)..(423): a, c, t, g, unknown or other
  misc_feature (423)..(423): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcaggccagtcagagtgtancagctaacttagcctggtaccagcaacgaaccgtgacccagccctaccgaggcctcctctatctagtcggtagcctacgtcccggacgacggggacccaccgtaggaacctccccgagtcccgtaaggttccaggtcggactacgtcggggtactaggggaactggtcgttccaaccgtcctaccaactanccgacgaccacgtcccgtagcgtacggtactaggtaaagtttatttagggttaaaacttttgttaccgttggttccctaggttacaaacgttaacgtactacggtacggtccggtacccggttaacgggtacccggtttaaccggaacccggggtaaaacgggtaaccgtaaaaggggttaacggtaaaacctaaacggtaaaaccggttacgtaacgggtccgggtaactcggaacccgtaaacgttactccggtttacctacctttaccgtttaacccg

SEQ ID NO: 346659 - DNA, 558 bp, Homo sapiens
  misc_feature: GZ8MTXP02GNKYG.21.65.F10.1.454.CMB.2.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtaccagcaagaaacctggaccagccctcccgaggcctcctcatctatgggtncatcccgcgagggccagtcggaactcccagcccaggttcaggtcgcacgtgggtctgggacngtacgttcacgtctacacatccagcacgcctgactagtctagtaacgttattttagtaaagttttctttcgtgttactgtactagtacaagtcgacggtcgcccgttagggaccgttcggaacgtaacgggacgtaaaggtagaaactacgaaacgtacgtgcggactgactacactctacgttacctcgtacc

SEQ ID NO: 346660 - DNA, 662 bp, Homo sapiens
  misc_feature: GZ8MTXP02HQLGM.21.65.F10.1.454.CMB.2.raw
  modified_base (310)..(310): a, c, t, g, unknown or other
  misc_feature (310)..(310): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagcccacctgtctgtgtctccgaggggagagacgccaccctctcctgcagggccagtcagagtgttagcagctaacttagcctggtaccagacaagaaacctggccacgccctcccgaggtcctcttacacttctagtcggtcnccacgtccccggaccgacggggccctaacggttacggaaacctcccccgagcccgtagggttcacggtcggactacggttggggtactaggggactagggtacgttccaactcctaaccaccgtataccgacgacacgtccctgcctagttacgtaggtaaagtttagttttagttaaagtttttctttacgttgttcttaggtactagtaactaatcgtaggtcggccgttacgggtacgttcgggaccggtaaacggaccgtaaagggtacggaaaactaacggtaaaacgtacgtacggtaacggtctaacggacgtaacctacgtccgttcgttactttacgtaaccc

SEQ ID NO: 346661 - DNA, 638 bp, Homo sapiens
  misc_feature: GZ8MTXP02H1WRA.21.65.F10.1.454.CMB.2.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (382)..(382): a, c, t, g, unknown or other
  misc_feature (382)..(382): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacncccaccctctcctgcgagggccagtcagagtgtagcagactaacttgcctggtaccagcagaacctggccagccctccaggctcctnatctatggtncacgtcccgccgtaacggggccctaagtggaaacctcccgaagcccgtaggttcacggtggcctacggtggggtactggggaacnggtacgttcaccgtcctacacctatcacgacacgcctaggccagttctagtaaagtttagttttagttacgttttattctggttcctggtactaagtactaatcgtaacggtcggtaccgtcggggtaccgtttccgggaacccgaaaacggggtacaaaacgggggttcggaaaaacttacccgaaaaggtaaccggtggttaacggaccgtaacggacccaactacgttccgtacggtttccttacgtaccccg

SEQ ID NO: 346662 - DNA, 621 bp, Homo sapiens
  misc_feature: GZ8MTXP02IKJKG.21.65.F10.1.454.CMB.2.raw
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagagcccaccctctcctgcagggccagtcagagtgtagcagcaacttgcctggtaccngcaagaaacctggccagcctacccgaggcctccncatctagtggtncagtccgcgaggccacgtggaactcccgagcctaggtcaggtcggaccacgttcggggtctagggaactaggtaactttccaacctttccgaccacgaattccgaaacgcgacgccctgccgtaagttctaagaaagtttagttttcggtaaattttacgtttactggttacttacggtactaagttactaaacttgaacggtcggtaccgtcgggaaaccggtttcggaacgaaaacgggtaccaaaggggttacgaaacttaacgaaaacggtactaggtagacttaacggcaaccgtacgtactcgtaccttgtaacccg

SEQ ID NO: 346663 - DNA, 586 bp, Homo sapiens
  misc_feature: GZ8MTXP02GA9ZF.21.65.F10.1.454.CMB.2.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
  modified_base (367)..(367): a, c, t, g, unknown or other
  misc_feature (367)..(367): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcgagggccagtcagagtgtagcagcaacttgcctgaccagcaagaacctgccagcctccagcctcctcatctagtggtcnctagtcccgcgacgggcccacgtggaacctcccgaagccgaggttcaggtcgactacgtggggtctggggacnggtagttccacttcgaccactatccagcacgcctgactagtctagtaaagtttacgtttttagaagttttctttgtcggtacttaggactaagtaactaagtccgaggttccggtacgttacgggaccgttaccgggacgtaaacgggaccgtaaggtaggaaacttacgaaaacgtcgtagccgtacaacgacctactacgtctacgttccttactcc

SEQ ID NO: 346664 - DNA, 731 bp, Homo sapiens
  misc_feature: GZ8MTXP02I4DG8.21.65.F10.1.454.CMB.2.raw
  modified_base (308)..(308): a, c, t, g, unknown or other
  misc_feature (308)..(308): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagcccaccctgtctgtgtctccgaggggagagacgcccaccctctcctgcgagggccagtcagtagtgttagcagactaacttgcctggtaccagcagaacctggccacgccctccgagcctcctcactctagtgggtcnccgacgtccccggaccgtacggggacccctacgtacggaacctccccgaagcccgtaagggttccacgggtcggacctacggttcggggtcgtacggggaactaggggtaccttaccaaccgttcctaccgaaccctagtaccgacgtaccgtaccgtcccgttgaaccgttagttaccgtaaggtaaacgttttagtttttaaagttaaacgtttttactttccgttagtttaccgttacgtacgtaaagttacctaagtccggtagggttaccgggtcccgttaacggggtaccggttccgggaaaccggaaacggggtaaacgtaacggggtaacggtaaaacgttaacgaaaacccggtagtacggttccggactaacggaccctaacgtcgttacgttcgtttaccctacttaccccg

SEQ ID NO: 346665 - DNA, 691 bp, Homo sapiens
  misc_feature: GZ8MTXP02JD4ZK.21.65.F10.1.454.CMB.2.raw
  modified_base (316)..(316): a, c, t, g, unknown or other
  misc_feature (316)..(316): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccgaccctctcctgcgacgggccagtcagagtgttagcagactacttacgctacggtaccagcaacgaaacctcggaccacgccctaccgacggtcctcctcattctagtggtcncacgtccgaccgaggccacgtggaacctcccgagccgtaggttcacggtcgactacgtcggggtcgtacggggacaggtacgttacacgtacctaccaacctactcgaaacgtcgaacgtccctaggacctacgttacctaggtaaagtttaacgttttagggtaaaatttttctttacccgttgttcgtagtaaccgtaagtttaaccgtaacttcggtaagggttccggtacccgttacgggtaaccgggttaccgggaacccgtaaaaggggtacccgttaaaagggttacggaaaaactccggtaaaacgtacggttacggacgttacgaacggtaccacgtacgttccgttacgttccgtaacttccccg

SEQ ID NO: 346666 - DNA, 646 bp, Homo sapiens
  misc_feature: GZ8MTXP02F3KOB.21.65.F10.1.454.CMB.2.raw
  modified_base (368)..(368): a, c, t, g, unknown or other
  misc_feature (368)..(368): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcaagaacctggccagccctccaggcctcctcatctagtggtacgcactccgccagggccacgtcggaactccccagccaggttcaggtcgccacgttggggtctaggggacnggtacttcactcctacacctatccagtcacgcctagcagttctagtaagttattttacgtaaagttttctttacgtggttacctaggcctaagttaacctaaagttccgaacgggttcggtaccccgttacgggggttaacccgttaccgggggaacccggtaaaacgggggaaaccccgtaaaaggggtacggtaaaaaccgtaaccgaaaacgtaaaccggttggtacgggcctaacggtaccaaccgtattacctacggtacctttcgtaacccg

SEQ ID NO: 346667 - DNA, 548 bp, Homo sapiens
  misc_feature: GZ8MTXP02FXDRS.21.65.F10.1.454.CMB.2.raw
  modified_base (372)..(372): a, c, t, g, unknown or other
  misc_feature (372)..(372): n is a, c, g, or t
  modified_base (426)..(426): a, c, t, g, unknown or other
  misc_feature (426)..(426): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagcaacttagcctggtaccagcaagaaacctggccagccctcccgaggcctcctcatctatggtgcactcccgccacggggcccacgtcggaactccccgagccgaggttcaggtgctacgtggggtctggggacnggtacgttcacttctcacatcagcacgctgcagtcagtaatattttgaagtttntttctgtctagctaagtacaatcgagtcggccgtcggacgttcggaccgaagggaccgaagggtagaaaactacgaaaacgtacgtacggtcgactgacgactacgtctacgtcttctaccg

SEQ ID NO: 346668 - DNA, 551 bp, Homo sapiens
  misc_feature: GZ8MTXP02GNUXA.21.65.F10.1.454.CMB.2.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagtcgtcgctcgcacgaccggtgctcgatttagctacgctctaagggggtaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttagcctggtaccagcaagaaacctggaccaggccctcccaggcctaccnatctatggtncacgtccgcagggtccactggaactccagccaggttcagtggcacgtggtcgtaggggacngagttcacttcncaccancagctacgcngcagtagtagtaagttatttagttagtttattnttgtntgtatataactatacgtagtcggtcgtcggtacggtacggacggaacggaacggaaggtaagaaacgtaaacgaaacgtaacgtacggtagtacgtaacgtacgactactcgtcgtctactac

SEQ ID NO: 346669 - DNA, 555 bp, Homo sapiens
  misc_feature: GZ8MTXP02F2AZG.21.65.F10.1.454.CMB.2.raw
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtaccagcagaaacctggccagcctcccgaggcctcctcagtctagtcggtacgcacgtccccgacgacggggccacgtaggactcccagccaggtcagtcgcagtggtcaggangngtcactctcacntcagcacgctgctagtctgtaatnttttagagttttcttagttgtcttgactaagtacctatcgaggttcggccgttcgggacgttaccgggactaacggggaacctagggtagaaactacgaaaacgtacgtaggtacgacgtgaccctaatacttcgtacgttcctacgtaccg

SEQ ID NO: 346670 - DNA, 646 bp, Homo sapiens
  misc_feature: GZ8MTXP02IHWDL.21.65.F10.1.454.CMB.2.raw
  modified_base (300)..(300): a, c, t, g, unknown or other
  misc_feature (300)..(300): n is a, c, g, or t
  modified_base (442)..(442): a, c, t, g, unknown or other
  misc_feature (442)..(442): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccacctgtctgtgtctccgaggggagagacgcccaccctctcctgcgagggccagtcagagtgttagcagactaacttgccgtggtaccagacaagaaaccgtggaccacgccctacccgagcctcctanatctagtggtgacctacgtcccgccgtacgggaccctaacgtacggaaacctccccgaagtcccgtaggttctacggtcgacctaccggtggggtactaggggacacgggtacttacaccttcctaccaacctagtccaaancaacgtccgtagactagtcgtaaggtaattaagttttgtaaattttcttcgttagttcgtagtacaagttaacagtacgaggtacggtccgtacgggtaacgttcccggaaacgaaaacgggtaccgaaaggttaaggaaaactaaaccgaaaacgtacgtacgtagaccgaagacctaacgttctacttcgttacttactacg

SEQ ID NO: 346671 - DNA, 535 bp, Homo sapiens
  misc_feature: GZ8MTXP02JUOA4.21.65.F10.1.454.CMB.2.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctccaggctccncatctatggtncatcccgccgagggccagtggaactcccagccaggttcagtggcacgtggggtctggggacagtagttcacttctacaccatcagcagcctgcagtctagaagtattttagagttttatttcgtgttctgtacagtacaattcgaggtcggccgtcggacgttccggacaagggacctaaggtaggaaactacgaaacgtacgtggtacggctcgacaccgatccgtcgtacttactacccg

SEQ ID NO: 346672 - DNA, 592 bp, Homo sapiens
  misc_feature: GZ8MTXP02JLSMP.21.65.F10.1.454.CMB.2.raw
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (452)..(452): a, c, t, g, unknown or other
  misc_feature (452)..(452): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccaccctctcctgcagggccagtcagagtgttagcagcaacttgcctggtaccagcaagaaacctggccagcctcccaggcctcctnatctagtggtncactcccgcgaggggcccagtcggaactccccgagcctaggttcaggtgctacgtggggtcaggggacaggtacgttcacgtcctacacctatccaagccacggccctgactagtctaggtaagttatttttaggaagtttttactttcgttnttctgtacgtaagttactaattccgaaggtcggtccgttacgggtaccgttaccgggacgaaacggggtaccgaaggggtacgaaaactacgtaaaacgtacgtggtacggactggaccacctatcgtcgttactctaac

SEQ ID NO: 346673 - DNA, 593 bp, Homo sapiens
  misc_feature: GZ8MTXP02H4CH9.21.65.F10.1.454.CMB.2.raw
  modified_base (302)..(302): a, c, t, g, unknown or other
  misc_feature (302)..(302): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagctaacttgcctggtaccagcaagaacctggaccagccctcccgaggcctcctcatctagtgggtncactcccgcgacgggccacgtggaactcccgagccgtaggttcaggtcggctacgtggggtctaggggacaggtacgttcaccgttcctaccgaccaatccgaacgcacgcccttggactagttctaggtaattatttaggttaattttactttctgttcctgtacagttacaatcgtaggtcggtacgtacgggttacgtcggacggtaaacggaccgaaaggggttacggaaactaccgaaaacgtcgacggttacgactcgaccactacgtctacgttcctactaccg

SEQ ID NO: 346674 - DNA, 548 bp, Homo sapiens
  misc_feature: GZ8MTXP02FL8BE.21.65.F10.1.454.CMB.2.raw
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctgccagcctcccaggctcctcatctatggtgcatccgccacggggccacgtggaactccccagccaggttcagtggcacgtgggtctggggacngacgttcactctcacntcagcagccctgcaagtcagaaagttatttttagaagttttatttcctagtcttgactagtaacaatcgaagttggcccttcgggacgttcgggaccgaaaacggggaccaaagggtaggaaaactacgaaaacgaccgttgacggtcaacgacaccattccgtactcttactacc

SEQ ID NO: 346675 - DNA, 640 bp, Homo sapiens
  misc_feature: GZ8MTXP02FQM1U.21.65.F10.1.454.CMB.2.raw
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggaagaaatagtgatgacgcagtctccagcccaccctgtctgtgtctccgaggggagagacgcccaccctctcctgcgagggccagtcagagtgttagcagcaacttagcctggaccagcaagaaccgtggaccagccctcccgaggcctcctcatctagtggtcgcacgtcccgcgacgggcctacgtacggaactccccgagccgtaggttcacggtcggctacggtggggtctaggggacaggtctcactcctcacatcagcacgcctgctagtctagtaagttattttagtaagttttatttcgtagtctagtactaagttaactaatcgtaggtccggtacccggttacggggtaccggttaccggggaacccggtaaaacggggtaaccggtaaaaggggttaaacggtaaaacgtaaaccgaaaaccggtacgtacggtacggtactaacgaccctaaccgtacttaccgtacgttaccttacgttacccg

SEQ ID NO: 346676 - DNA, 664 bp, Homo sapiens
  misc_feature: GZ8MTXP02HQ5W8.21.65.F10.1.454.CMB.2.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (466)..(466): a, c, t, g, unknown or other
  misc_feature (466)..(466): n is a, c, g, or t
tcagtcgtcgctcgcacgaccggtgctcgatttagctacgctctaaggggggaggaactgctcagttaggacccagacggaaccatggaagccccagcgcagcttctattcctcctgctactctggctcccagaaagctctggagaaatagtgatgacgcagtctccagccaccctgtctgtgtctccgaggggagagagcccacccctctcctgcagggccagtcagagtgttagcagcaacttgcctggtacagcagaacctggccagcctcccagcctcctnatctatggtncatcccgcgacgggccacgtggaactcccgagtccgaggttcaggtcggctacgtggggtctacggggactagggtacgtttccaccttccgtacaaccctatcccgaaggccaacggcccttaggctaaggttcgtaggtaaaagtttagtttttaggtaaaagtttttntttccgttggttccttaggtaaccttaagttaacaaagttacgagggttccggtcccgttacggggttaccggtttaccggggaacccgaaaacggggtaaccgtaaaaggggttacggaaaacttaaaccggaaaaaccgtagttcgggtacggacgtaacgacctaacctacgttcgtacgtttcctttactaccg

SEQ ID NO: 346677 - DNA, 692 bp, Homo sapiens
  misc_feature: GZ8MTXP02HG2J5.21.65.F10.1.454.CMB.2.raw
  modified_base (197)..(197): a, c, t, g, unknown or other
  misc_feature (197)..(197): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctccgtgcgagggccagtcaggagttgtagcagacaacttacgcctggtaccagcaacgaaacctcggaccagcccctcccgagccctccgtacacgtctagtggtcgctacgtcccgccgacgggaccacgtcggaactcccgagtcccgtaggttcacggtcggactacggtgggtcgtaggggactaggtacgttacaccttcacccaacgtatccgaagaccacgtcccgtgaactagtcgtaagttaaagtttatttttagggtaaactttttgtttccgagttttacgcggtaactaaacggtaccgtaaattccgaaggggtttccggtacccggtttaacgggaccggtttaccggggaaacggtaaaccgggtaacggtaaaaggggtaaacgtaaaaccgtaaccggaaaacgtaacggttcgaaacggtcgtaacgaacccttctaacgttcctcgttacctaacttcccg

SEQ ID NO: 346678 - DNA, 556 bp, Homo sapiens
  misc_feature: GZ8MTXP02F63RV.21.65.F10.1.454.CMB.2.raw
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgtagcagcacttagccgtggtacccagcaagaaacctggaccagccctcccaggcctcctcatctanggtncatcccgcagggccacgtggactcccgagccgtaggttcagtggcctagtggggtctagggacnggtcgttcacgtctacaacntcagcagcctgcagtcnggtaaagttnttttagaaagttttntttacgtgtctgctaagttacatcgagtcgccgtcggacgtcggacgaagggtaccaagggtagaaacttaacgaaacgtacgtagtacggactaacgacctaacccgtatccgttactcgtttactaccg

SEQ ID NO: 346679 - DNA, 637 bp, Homo sapiens
  misc_feature: GZ8MTXP02IBJZO.21.65.F10.1.454.CMB.2.raw
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (383)..(383): a, c, t, g, unknown or other
  misc_feature (383)..(383): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagccaccctctcctgcagggccagtcagagtgttagcagctaacttagccctggtaccagcaagaacnggccacgccctcccaggcctcctnactctagtggtcgctactcccgaccgacgggcccacgtcggaactcccccgagcccgtaggttcacggtggcctacgtggggtctaggggacnggtacttccactctcaccatcagcacgctgcagtctagaagttattttaggtaattttactttcttagttcgtggtactaagttactaagttcgtaggttcgggtccgttacggggtaccggtttaccggggaaccgtaaacggggtaaccggtaaaggggttaacggtaaaaccgttaaaccgaaaaccggtacgttacgggtcgggaacgtcggacccgtaccgtacttacgttccgttaccttacgttacc

SEQ ID NO: 346680 - DNA, 633 bp, Homo sapiens
  misc_feature: GZ8MTXP02GOO7Y.21.65.F10.1.454.CMB.2.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagagccaccctctcctgcagggccagtcagagtgtagcagcaacttagcctggtaccagcaagaaacctggccagcctcccagctccnatctatgtncntcccgcnggccactggaactcccgagccgtaggtcaggtcggctacgtgggtctgggacagtcgttccacgtctccaacctntaccacgcacgtccctaggctaggttcctaggtaacgtttattttacgtaagtttttactttcgttcgttcgtgtacgttaagtaacctaagttccgaggttcggtacccgttcgggtaaccggttccggaaccgggtaacggtaaccggtaaaaggggtacggtaaaaacttaccggaaaaacgtacgttaggggtcggtaacgtacggtaaccctaacgtcgttacttcgtttacctttactaacctttcccccg

SEQ ID NO: 346681 - DNA, 546 bp, Homo sapiens
  misc_feature: GZ8MTXP02IIQFP.21.65.F10.1.454.CMB.2.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccacctgtctgtgtctccagggganagagccaccctctcctgcagggccagtcagagtgttagcagcaacttagcctggtaccagcagaaacctggaccagcctcccaggcctcctcatctatggtcncatccgcagggccagtggaactcccagccaggttcagtggctagtgggtctggggacngggtnttcacgtctccacatcagcagcctgcagttctagtaaagtnttttagaaagttttcttactgttactgactaagttacaatcgaagtcggcctcgggtacttcggaccgaagggacctaaagggtcgaaactaccgaaaacgtcgtagtcggactgacctaacacttcgtcgttacttcgtaaccg

SEQ ID NO: 346682 - DNA, 542 bp, Homo sapiens
  misc_feature: GZ8MTXP02G5WB3.21.65.F10.1.454.CMB.2.raw
  modified_base (195)..(195): a, c, t, g, unknown or other
  misc_feature (195)..(195): n is a, c, g, or t
  modified_base (379)..(379): a, c, t, g, unknown or other
  misc_feature (379)..(379): n is a, c, g, or t
  modified_base (437)..(437): a, c, t, g, unknown or other
  misc_feature (437)..(437): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagccaccctctcctgcagggccagtcagagtgttagcagcaacttgcctggtaccagcagaaacctggccagcctcccaggcctcctcatctatggtgcatcccgcgagggcccacgtggaactccccagccaggttcacggtggctacgtggggtctaggggacaggtagttcacgttccncaccgatccagcacgcctgacagtctagaagttattttagactttatttctgttctgntagtacatcgagtggcctggacgttcggaccgaagggaccaagggtagaaactacgaaaacgtacgtggtacgcgtcgactaccgtactcgtcgtcttactaccg

SEQ ID NO: 346683 - DNA, 697 bp, Homo sapiens
  misc_feature: GZ8MTXP02GB3J0.21.65.F10.1.454.CMB.2.raw
  modified_base (355)..(355): a, c, t, g, unknown or other
  misc_feature (355)..(355): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttgcctggacccagcaagaaacctggaccacgccctcccgaggcctcctcatctagtgtgcatcccgcacgggccacgtgactcccagcctaggtcaggtcgctagtggttcgngggactggtacgttccaacgttccaccaacccatccaacgcctaacggccctgacctaagggtttacccaggtaaaacgtttgtttttaaagtaaaggtttttacttttccgttggttaccttacgtacgtaacgttaaacctaaagtaccgtagggttaccgggtcccgttaccgggggttacccgttaccgggggaaacccggtaaaacgggaaacccgggtaaaaggggttaaacgtaaaaccgaaaaccggtaaaaaccgtaaccggttaggttacggaacccgttaacggtacccaaacccggtattcggtttaacgttcctttacgtttaaacccg

SEQ ID NO: 346684 - DNA, 569 bp, Homo sapiens
  misc_feature: GZ8MTXP02F9GRA.21.65.F10.1.454.CMB.2.raw
  modified_base (303)..(303): a, c, t, g, unknown or other
  misc_feature (303)..(303): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggaagaaatagtgatgacgcagtctccagccaccctgtctgtgtctccgaggggagagagccaccctctcctgcagggccagtcagagtgttagcagcaacttagcctggtaaccagcaagaaacctggccacgccctcccgaggcctcctcatctatggtncagtcccgcgacgggcccacgtggaactcccgagcctaggtcagtcggcagtgggtctaggggacaggtcgttcctactcgtaccaactagtccaagcacgcctgactagtctagtaaagttattttagtaaagttttattcgttgtctagactagttaacaatacgaggtcggccgttcgacgtcggacgaaaggaccgaaggtagaaaactacgaaaacgtacgtgtacggcctaagaccacctaactcgtcgtacttactacc

SEQ ID NO: 346685 - DNA, 646 bp, Homo sapiens
  misc_feature: GZ8MTXP02J26MT.21.65.F10.1.454.CMB.2.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (390)..(390): a, c, t, g, unknown or other
  misc_feature (390)..(390): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagacgcccaccctctcctgcagggccagtcagagtgttagcagcaattgcctggaccagcagaacctggccacgcctccagctccncatctagtggtncactccgccgacgggccaacgtggaactccccgagacccgtagggttccaggtccggacctaggtggggtcgtggggactaggtacgtccaccttcnccaaccatccgacgacctacggtcctggtactaacggttgtaggtaaattacgtttttagtaaacgtttttagttctggttacttgacgtagttaaccaacttcgtacgttcggggtacccttacggggtccggtttaccggaccgaaaacggggtacccgtaaaaggggtaacgaaaacctaccggtaaaaacgtacgtggtaacggtcctaacggccaaccgtactccgttacgtccttacctactttcccccg

SEQ ID NO: 346686 - DNA, 648 bp, Homo sapiens
  misc_feature: GZ8MTXP02JBH4Q.21.65.F10.1.454.CMB.2.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggagaaatagtgatgacgcagtctccagccaccctgtctgtgtctccgagggganagacgccaccctctcctgcagggccagtcagagtgtagcagcacttgcctgaccngcaagaacnggccagcctccaggcctctcatntatggtcnctactccgacgacggcctagtcgacctccgcgtccgtaggtcacggtccgtacgtacggtcgggtacgtagggactacggtcttaccaccgttactaccaaccgtagtaccgaacgaccgtacgtccgtacgacgtacgttacgtaagtaacgtttagttttaacgttaagttttcttacgtcgttaccgttagtactaacgttaactagtccgtacggtccggtaccggttaccgggtacggttaccgggaaacgtaaacgggtaaccgtaaagggtaaccgtaaaacgtaacgtaaacggtacgttacggtcgtacgtaacgactaaccgtacttcgttacgtaccttacgtccg

SEQ ID NO: 346687 - DNA, 738 bp, Homo sapiens
  misc_feature: GZ8MTXP02GM5I2.21.65.F10.1.454.CMB.2.raw
  modified_base (311)..(311): a, c, t, g, unknown or other
  misc_feature (311)..(311): n is a, c, g, or t
  modified_base (524)..(524): a, c, t, g, unknown or other
  misc_feature (524)..(524): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcgacgggccagtcagagtgttagcagcaacttagcctggtaccagcaacgaacctggaccagccctcccgaggtcctccgtacactctagtcggtcncctacgcccgccgacgggcctacgtaggaacctcccgagaccgtaggttaccgaggttcgccgtacggttcggggtacgtacggggaactaggtacgttacctacccgtacctaccaaacccgtattacccgaacggtacctaccggtcccgtagacccggtaagttaccgtaaggttaaaagttttaggtttttaacgttaaaccgtttttntttacggttcgttacgttagaaccgttaaggtaaacctaagtccggtacgggttccggtaccgggttaccgggtaccggttaccggggaaaccgtaaacgggggtaacgtaaaacggggtaacggtaaaacgttaaaccggaaaacggttaccgtacgggttacggtacctaacggaacctacgtacttacggttcttaccgttacttaacccg

SEQ ID NO: 346688 - DNA, 591 bp, Homo sapiens
  misc_feature: GZ8MTXP02HC9LP.21.65.F10.1.454.CMB.2.raw
  modified_base (195)..(195): a, c, t, g, unknown or other
  misc_feature (195)..(195): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccaccctctcctgcagggccagtcagagtgttagcagctaacttagcctggtaccagcaagaacctggccagccctccgagcctctcatctagtggtcgctacgtcccgacgacgggcccacgtggaacctccccgagcccgtaggttcacggtcgcctaggtcgggtcgtagggactaggtcttcaccgtcaccgacatcagcacgcctgacctagtactaggtaaatttgttttaggtaaattttcttaccgtggtttcaggtactaagtactaaatcgtaaggtcggtaccgtacggtaccggttacggaaccgtaagggaacctaggggtacgtaaaactacgaaacggtatggtacgctaagactactatcttacgtctactcccg

SEQ ID NO: 346689 - DNA, 683 bp, Homo sapiens
  misc_feature: GZ8MTXP02I0L4Q.21.65.F10.1.454.CMB.2.raw
  modified_base (195)..(195): a, c, t, g, unknown or other
  misc_feature (195)..(195): n is a, c, g, or t
  modified_base (303)..(303): a, c, t, g, unknown or other
  misc_feature (303)..(303): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaacttagcctggtaccagcaagaaacctggaccagccctcccgaggtcctcctcatctatggtacncacgtcccgcgacggcctacgtaggaacctcccgaagtccgtaggttcaggtcgaccgtacggtcgggtcgtagggactggtacgttaccaccgttcctaccaactagtaccgacgacgtacgtccgtcgacgtacgtacgtaggggggtaattagttttaagtttaagttttacgtttacgttacgttacgttacgtacgtaacgttaactaacgtacgtacggttaccggtaccggttacgggttaccggttaccgggtaaccgggtaaacgggtaaccggtaaacgggtaaacggtaaacgtaaacgtaaacgtaacgtacggtacggtaccgtaacgtaccgtaccgtacgttacgttacgttaccgttactaccg

SEQ ID NO: 346690 - DNA, 507 bp, Homo sapiens
  misc_feature: GZ8MTXP02HIDA3.21.65.F10.1.454.CMB.2.raw
  modified_base (194)..(194): a, c, t, g, unknown or other
  misc_feature (194)..(194): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (380)..(383): a, c, t, g, unknown or other
  misc_feature (380)..(383): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
  modified_base (407)..(408): a, c, t, g, unknown or other
  misc_feature (407)..(408): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccagggganagagccaccctctcctgcagggccagtcagagtgttagcagcaaacttagcctggtaccagcaagaaacctggccagccctcccaggcctcctcatctatggtgcactccggcagggccaacgtggaatcccagccaggtcagtgcactgggtctgggacngngttcactcacacatcagcagtcnnnntnagtattagtattattntntntnnatanatanagtcgtcgtcgtacgtcgacgaacggaacgaaggagaaacgtaacgaaacgaacgtacgtacgacgtaacgacactactacgtctctactc

SEQ ID NO: 346691 - DNA, 590 bp, Homo sapiens
  misc_feature: GZ8MTXP02H0CAR.21.65.F10.1.454.CMB.2.raw
  modified_base (293)..(293): a, c, t, g, unknown or other
  misc_feature (293)..(293): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaacctggccagcctcccaggctcctcatctatggtncatccgccaggggcccagtggaatccccgaagcccgtaaggttcacggtggcctacgtggggtctggggacaggtagtttcacttcctaccaccaatcagccagccctgccaagtctagaagttatttaggtattttatcttgtctgtctagtacaatcaggtcgaccgtcggtaacggtttccggaaccgaaaacggggtacccgaaaaggggttacggaaaacttaccgaaaacggtaaacgtgggtacgggtactaagggaccaaccgtacttcgttacgttctttaaccctcg

SEQ ID NO: 346692 - DNA, 568 bp, Homo sapiens
  misc_feature: GZ8MTXP02FJRY2.21.65.F10.1.454.CMB.2.raw
  modified_base (288)..(288): a, c, t, g, unknown or other
  misc_feature (288)..(288): n is a, c, g, or t
  modified_base (535)..(535): a, c, t, g, unknown or other
  misc_feature (535)..(535): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcaacttagcctggtacccagcagaaacctggaccagcctcccaggctcctnatctatggtcgcatcccgccagggccacgtggaactccccagccaggttcagtggcacgtggggtctggggacaggtacgttcacgtctaccactatcacgcacgcctgactagtcgtagtaaagttatttttagaaagttttatttcgtgttctgacctagtaactagtcctaggtcggaccttcgggtacgttccggaccggaaacgggaaccgaagggtaggaaaacgtcgaaaacgtacgtgnggactgaccaacctagtcttacgtcttactacc

SEQ ID NO: 346693 - DNA, 571 bp, Homo sapiens
  misc_feature: GZ8MTXP02H0N2S.21.65.F10.1.454.CMB.2.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaagctctggagaaatagtgatgacgcagtctccagccacctgtctgtgtctccaggggnagagcccaccctntcctgcacggggccagtcaggagtgttagcagctaacttagccctggtaccagcaagaaacctggccacgcctcccgaggcctcctcattcctaagtcgggtnccagtcccgcgagggccacgtggaactcccagtccaggttcagtcggctacgtgggtctgggacaggtcttcactctcgaccatccagtcagtcctagcgtagtactaggtaattattttaggattttatttcgtgttctagctagttacatccgtagtcgtacgtcggtacgttcggaccgtaacggggtaccaagggttacggaaactacgaaaacgtacgtggtacgcgtaacgacctactacgtcgtacgtctttacgac

SEQ ID NO: 346694 - DNA, 799 bp, Homo sapiens
  misc_feature: GZ8MTXP02GXN69.21.65.F10.1.454.CMB.2.raw
  modified_base (195)..(195): a, c, t, g, unknown or other
  misc_feature (195)..(195): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcagggccagtcagagtgttagcagactaacttagcctggtaccagcaagaaacctggaccacgccctcccgaggcctacctcatccgttagtcgggtcactacgtccccggaccgacggggtcccacgtacggaactcccccgaagtcccgaggtttcacgggttcggccgtacggtcggggttcgtacggggacgtacggtacgtttacccaaccgttccgtaacccaaccctaagtcccgaaacgtccgaaccgtcccgtgtaccgtacggttaccttaaggtaaaggttttaaagtttttacggttaaaaggttttttaaccttttacggtttacggtttcccgttacgggttaaccttaacggtttaaacctaaggtttacccggtaacgggtttcccggggtaacccggttaccgggggttaacccggtttacccggggaaacccggggtaaaacggggtaaaacccggttaaaaggggtaaaggtaaaacccgttaaaccggaaaacggttaaccgtggtaccggtacgtaaccggtaaccaaccgttacgttcgttacggtttacctttaccgtaccc

SEQ ID NO: 346695 - DNA, 634 bp, Homo sapiens
  misc_feature: GZ8MTXP02HBY3L.21.65.F10.1.454.CMB.2.raw
  modified_base (196)..(196): a, c, t, g, unknown or other
  misc_feature (196)..(196): n is a, c, g, or t
  modified_base (606)..(606): a, c, t, g, unknown or other
  misc_feature (606)..(606): n is a, c, g, or t
  modified_base (627)..(627): a, c, t, g, unknown or other
  misc_feature (627)..(627): n is a, c, g, or t
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccaccctctcctgcgagggccagtcagagtgttagcagctaacttagcctaggtaaccagacaacgaacctggaccacgccctacccgaggtcctcctcatcgtagtggtcacacgtcccggacgacggggacctacgtacggaacctcccgagtaccgtaggttcacggtcgctacggtgggtacgtgggactaggtcgttcacttccactacactcgacgctacgcctaggacctaggtactaggtaagtttagtttaagttaaagttttcttacgttcgttagtcgtaacgtacgttaacctaagttccgaacggttccggtcccggttacgggtaccgttaccggaaacggttaaccgggaacgtaaggacgtaaacgtacgaaaacgtcgtagcggtacncgactacgtctctacgtaccncgttacc

SEQ ID NO: 346696 - DNA, 529 bp, Homo sapiens
  misc_feature: GZ8MTXP02GC6GW.21.65.F10.1.454.CMB.2.raw
  modified_base (196)..(196): a, c, t, g, unknown or other
  misc_feature (196)..(196): n is a, c, g, or t
tcagtcgtcgctcgcacgaccggtgctcgatttagctacgctctaaggggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagagccaccctctcctgcagggccagtcagagtgttagcagcaacttagcctaggtaccagacaagaaacctggccagccctcccaggcctcctcatctagtggtgcatccgccgagggccatgggaaactcccgagccgtaggtcagtcggcacgtgggctggggacagtgttccactcgtacaccgatcagcagcctgacctaggtactagaacgttagtttagtaatttattctgtctgactagaactatcagtgctggtacgtcgacgaaggacgaaggagaaatcaaaacgactcgtaggctagctacatactctactcactttcccg

SEQ ID NO: 346697 - DNA, 662 bp, Homo sapiens
  misc_feature: GZ8MTXP02F0MDU.21.65.F10.1.454.CMB.2.raw
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcagggccagtcagagtgttagcagcacttagcctggaccagcagaactgcagcctccagctcctnatctatggtncagtcccgcgagggccactcggaactccccgaagccgtaaggttcaggtcgcctaacgtggggtacgtaggggaactaggtacgttccaacttcctaccaaccctattccgaacgccaacggtccctagaccgtagttaccgtagtaaagtttagtttttagtaaaagtttttctttacgtggttcctaggtactaagttaaccaagtacccgtagtcgggtacccgttacgggtaaccggttaccggaaccggtaaaacggggtacccgtaaaagggtttaacggaaaacgttaaaccgaaaacgggtaaccgttaaggtcggtacgttaacggacccaaacctattaccgtttcgtacccttacttaacccg

SEQ ID NO: 346698 - DNA, 652 bp, Homo sapiens
  misc_feature: GZ8MTXP02HQRZY.21.65.F10.1.454.CMB.2.raw
  modified_base (197)..(197): a, c, t, g, unknown or other
  misc_feature (197)..(197): n is a, c, g, or t
  modified_base (211)..(211): a, c, t, g, unknown or other
  misc_feature (211)..(211): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctntcctgcacgggccagtcaagagtgttagcagctaacgtcgctaggaccagcaacgaaacctggaccacggcccctacccgaggtcccttacctataacttcgtacgtggtacgacaccgttccccgacgacgggcctaacgtcggaaacctcccgagtcccgtaggttcaggtccggtactacgggttcggggtactggggaactacgggttcgtttcaacctttcctacgaacctataccgacgcacggtccaggcctagttcagttaatttagtttagtaattttcttagttcgttctgtactaacgttacaattcgagttacggtaccggttacgtacgggtaccgaaccggtaaggaccgtaaaagggtaacggtaaactaaccggaaaagtccgtagtacgactaacgacacttacgtctacgtactttactaccc

SEQ ID NO: 346699 - DNA, 574 bp, Homo sapiens
  misc_feature: GZ8MTXP02IWF3W.21.65.F10.1.454.CMB.2.raw
  modified_base (196)..(196): a, c, t, g, unknown or other
  misc_feature (196)..(196): n is a, c, g, or t
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
  modified_base (545)..(545): a, c, t, g, unknown or other
  misc_feature (545)..(545): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagcccaccctgtctgtgtctccgagggganagagccaccctctcctgcagggccagtcagagtgttagcagcaacttgcctggtaccaggcaagaacctggccagccctcccaggcctcctcatctatggtnctatcccgcgacgggcccacgtggaacctccccagccctaggttccaggtcggcacgttggggctcggggacnggtacgtccgaactctccaacgtatcacgcacgacctgcagttcagaagttatttagtagtttactttcgtagttctgtacgtaagtaccaattcgaggtcggtccgtcggtacggtttcggacgaaacgggtaccgaaaggtacgggtaaacacgtaaaacgacgttgacggntcgactaccacttcgcgttacctactacc

SEQ ID NO: 346700 - DNA, 648 bp, Homo sapiens
  misc_feature: GZ8MTXP02J0UDH.21.65.F10.1.454.CMB.2.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaacttagcctggtacccagcaagaaacctggccagccctcccgaggcctcctcatctatggtcncactcccgcgagggcccacgtggaacctccccgagcccaggttcaggtcggactacgttggggtcctaggggactggtacgtttccaccttcctaccacctatccaacgccaacgtccctgcctaagttcgtagaaagtttagttttaggtaactttttagtttctgttctacgtacgttaagttaacaacgttcgaacggttccggacccgttacggggtaccgttccggggaaccgaaacggggtacccgtaaaaggggtacggaaaacttaaccgaaacggtaacgtcggtacggtaccgcgtaacccgtacctacttacggtcgttacccttagtaaccccg

SEQ ID NO: 346701 - DNA, 565 bp, Homo sapiens
  misc_feature: GZ8MTXP02FJESW.21.65.F10.1.454.CMB.2.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (383)..(384): a, c, t, g, unknown or other
  misc_feature (383)..(384): n is a, c, g, or t
  modified_base (387)..(387): a, c, t, g, unknown or other
  misc_feature (387)..(387): n is a, c, g, or t
  modified_base (389)..(390): a, c, t, g, unknown or other
  misc_feature (389)..(390): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccaccctctcctgcagggccagtcagagtgttagcagcaacttagcctggtaccagcaagaaaccctggccagccctcccaggctcctnatctatggtcncactccgcgacgggccacgtggaactcccagcctaggtcacgtcgcacggtgggtcgaggggacngtcgtcactcnccacnncancnncgncngtcagtaatgtttagtaagtttattgtnttntaggntagtaacatccgtagtcgtccgttacgggacgttcggaccggaaacgggtaccaaggggtaggaaaactacgaaaacgtacgttcggacgactggaccctaacgtacttccggttacttccgttacttaccccg

SEQ ID NO: 346702 - DNA, 672 bp, Homo sapiens
  misc_feature: GZ8MTXP02HWA44.21.65.F10.1.454.CMB.2.raw
  modified_base (195)..(195): a, c, t, g, unknown or other
  misc_feature (195)..(195): n is a, c, g, or t
  modified_base (370)..(370): a, c, t, g, unknown or other
  misc_feature (370)..(370): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagacgccacctctcctgcagggccagtcagagtgttagcagctaacttagccgtggtacccagcaagaaacctggaccagccctcccaggcctcctcatctatggtgcactcccgccgagggccacgtaggaactccgagcccgaggttcaggtcgcctacgtgggtctgggacngtacgtcactctaccacatacagacacgcccgtgcgtagttaccgtagtaagtttagtttagttaaacgttttactttcgttagttccgtagacgttacgttaaactaaggtccgttaagggtccggtaccgttaccggggtacgtttaccgggaaccggtaaaacgggggtaaccctaaaggggtaaaacggtaaaacgttaaaccgaaaacggttaaccggtaggtaccgggttaacctacggtaacccgtaaccgtacgtttaccctacggtttccctttaacgtaccctttacccccg

SEQ ID NO: 346703 - DNA, 693 bp, Homo sapiens
  misc_feature: GZ8MTXP02HFK29.21.65.F10.1.454.CMB.2.raw
  modified_base (194)..(194): a, c, t, g, unknown or other
  misc_feature (194)..(194): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctccgagggganagacgccaccctctcctgcgacgggccagtcagagtgtagcagactaacttacgccgtaggtaccagacaagaaacctggaccacgcccctacccgaggtccctacctctaatcgtagtggtcgcgacgtcccgacgacggcctacgtcggaacctcccgagtaccgtaggttcacggtcggactacggttgggtacgtaggactaggtacgttacacttccgaccacgactacaaacggtccacgtccctagaccgtagtactaaggtaagtttagttttagtaagtttacgttcgtgttccgtagaaccgttaagtaccgtaacgttcgacgggtttcgacccggtttaccgggtacgggttacccgaaaccgggtaaacgggtaacggaaacggggttaaagaaaacgttaaccggaaaacgttaacgggttcggtacggttaaccgaacggtacctaccgtacgttaccgtaccgtttaccggtacttacccggg

SEQ ID NO: 346704 - DNA, 733 bp, Homo sapiens
  misc_feature: GZ8MTXP02IPA09.21.65.F10.1.454.CMB.2.raw
  modified_base (198)..(198): a, c, t, g, unknown or other
  misc_feature (198)..(198): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggcctcccagaaagctctggagaaatagtgatgacgcagtctccagccaccctgtctgtcgtctccgaggggganagacgcccaccctctcctgcgagggccagtcagagttgttagcagctaacttagcctggtaaccagcaacgaacctcggaccagccctccgacggcctaccctcatctatggtcactacgtcccggcgacgggcccacgtaggaactccccgacggcccgtaggttccacggtcggccctacggtggggtctacggggacctaggggttcgttaccaccgttccgtaccgaaccataccgagccaccggtctgacccgtaaaggttcctaaggtaacgttttaagtttttaacgtaacggtttttacttttccgttgggtttctaagttaccgtaagttaaacctaagttacgtacggttcgggtacccgttacgggggttccgtaacccggggtacgaaaaccgggggtaaaccgtaaagggggtaaacggtaaaaccgttaaaccggaaaaccggttacgttaacggggtcggtaccgtaacggacccgttaaaacccttcgttaccggtttaccgtacctttaaactccccg

SEQ ID NO: 346705 - DNA, 570 bp, Homo sapiens
  misc_feature: GZ8MTXP02G31MG.21.65.F10.1.454.CMB.2.raw
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgcctgtgtctccaggggagagagccaccctctcctgcagggccagtcagagtgttagcagcaattagcctggtacagcagaactgcagcctccagctcnatctanggtncatccgcagggccatggaactcccagccaggttcagtgacacgtgggctgggacaggtacttcacgttcncacatcagcacgcctcgcagtacgtagtaagttaagtttagttaagtttacgtttacgttagttacgtacgtacgtacgtaactaacgtacgtacgtacgtacgtacggtacgtaccggtacgtaacggtaaccggtaaacggtaacggtaaacgtaaacgtaaacgtaacgtacgtacgtacgtaacgacgacgtactacgtacgtacgtactac

SEQ ID NO: 346706 - DNA, 747 bp, Homo sapiens
  misc_feature: GZ8MTXP02HRZAF.21.65.F10.1.454.CMB.2.raw
  modified_base (195)..(195): a, c, t, g, unknown or other
  misc_feature (195)..(195): n is a, c, g, or t
  modified_base (405)..(405): a, c, t, g, unknown or other
  misc_feature (405)..(405): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcgagggccagtcagagtgttagcagcaacttagcctggtaccagcaacgaaacctcggaccacgcccctcccaggtcctcctcattcctagtgggtcgcctacgtcccggccgacggggtccccagttacggaactccccgagtccccgtagggttccacggtcggactacggttggggtcgtaggggacngggtactttcgacctttcaccacccagtccaggtaccacggtccctaggaccgtaaggttactaggtaaagtttaagtttttagttaaacgtttttactttccgttagttcttaggtaccgtaagtttacctaaaggttccgtaacggtttccggggaccccgtttacgggggtaacccggtttcccgggggaaaaccgtaaaacgggggtaaccgttaaaacgggggtttacggaaaaaaccgttacggtaaaaaccggtacggttcgggttaacccggggcttaacggaccccggttaccttaaggtttacccgttccggtttacctttacccgtccccg

SEQ ID NO: 346707 - DNA, 549 bp, Homo sapiens
  misc_feature: GZ8MTXP02GQW6D.21.65.F10.1.454.CMB.2.raw
  modified_base (195)..(195): a, c, t, g, unknown or other
  misc_feature (195)..(195): n is a, c, g, or t
  modified_base (295)..(295): a, c, t, g, unknown or other
  misc_feature (295)..(295): n is a, c, g, or t
  modified_base (385)..(385): a, c, t, g, unknown or other
  misc_feature (385)..(385): n is a, c, g, or t
  modified_base (433)..(433): a, c, t, g, unknown or other
  misc_feature (433)..(433): n is a, c, g, or t
  modified_base (518)..(518): a, c, t, g, unknown or other
  misc_feature (518)..(518): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagagcccaccctctcctgcagggccagtcagagtgttagcagcaattagcctggtaccagcagaaacctggcagcctcccgaggcctctcatctatggtncactccgcgagggcccacgtggaactcccgagtccaaggttcacggtggcctacgtggggtctggggactggcgttcactcctacactanccagcagccctgctagtctagaactagtttataagttttattctagtntcgatagactatcgagtcggtacgtcggtaagtcgacgtaacggacgaaggtagaaactaccgaaaagtacgttacggtcggacngaccacgtacttactcgttacttctaacccg

SEQ ID NO: 346708 - DNA, 724 bp, Homo sapiens
  misc_feature: GZ8MTXP02H0FAT.21.65.F10.1.454.CMB.2.raw
  modified_base (196)..(196): a, c, t, g, unknown or other
  misc_feature (196)..(196): n is a, c, g, or t
  modified_base (721)..(721): a, c, t, g, unknown or other
  misc_feature (721)..(721): n is a, c, g, or t
tcagtcgtcgctcgcacgaccggtgctcgatttagctacgctctaagggggggaggaactgctcagttaggacccagacggaaccatggaagccccagcgcagcttctcttcctcctgctactctggctcccagaaagctctggagaaatagtgatgacgcagtctccagccacctgtctgtgtcctcgagggganagacgcccaccctctcctgcgagggccaggtcagagttgttagcagcaattagcctggtacccagacaacgaacctcggaccacgccctacccgagcctcctacattctagtcggtgcacgtcccggaccggtacgggccctaacggtacggtaaacctcccgaaacggtccgtacggttacgacggtcgggacctacgggtggggtacgtacggggactacgtacgtttaccacgttcctacgaacctagacgacgaccgacgtccgtacgacgtaacgttacgttaaggtaaagttttaagtttttaagttagtttttaacgttcgtttagttaccgtagttacgtaaataaccgtattacgaacgggttccggtaccggttacggtaccggttccgggaaacgggtaaaccgggtaaaccggtaaaaggggttaacgaaaaacgtaaccggtaaaagttacggacgttacgggtactaaccggaccgttaacctaagttccggtttaacttcgtttaacccnccg

SEQ ID NO: 346709 - DNA, 727 bp, Homo sapiens
  misc_feature: GZ8MTXP02G50SZ.21.65.F10.1.454.CMB.2.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgccctacctctcctgcgacggccagtcgagtagtgtagcagactaacgttcgcgtacggtacagacaacgaaccgnggaccacgccctaccgagtcctacctcgtactcgtagtcggtcactaccgtcccgacggacgggacctaacgtacggaacctcccggacgtccgtaggttacgacggtcgacgtacggtcgggtcgtacggaactcgttacgtacctacgttaccaccaacctagtacgaacgctaacccgtcgtcgacgtacgttacgtaaggtaacgtttttagttttaaagttaaagtttttcgttccggttacgttacgtacggtaacgttaaacgttacgtaacttcggtaacgggtcccggttacggttaccggggtaccgggttaccggaaaacccggtaacggggtaaacgtaaacgggggtaaataaaccggtaaaccggaaaccggttggtaacgggtccgtacggtcgtaacccgtacgttacgttccttaccggttacttaaccttcccg

SEQ ID NO: 346710 - DNA, 699 bp, Homo sapiens
  misc_feature: GZ8MTXP02G7UNV.21.65.F10.1.454.CMB.2.raw
tcagtcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcagggccagtcagagtgttagcagctaacttgcctaggtaccagcaagaacctggaccagccctacccgagcctcctcattctatggtcgcacgtccgcgacgggccacgtgaactcccgagccaggttcacggtcgacctacggtggggtactaggggactagggtcgttaccacgtaccgtaccaaccagtaccgacgccacggtccctgggtacctaagggttcctaaggtaaaagttttagtttttaagtaaacgtttttactttacgttcgttacgttcgtaacgtaaacgtttacgaaacgtttccggaacgggttccgggtacccgttacggggtacccgtttacggggaacccggtaaaaggggttaacccggtaaaggggtaaccggtaaaacgttaaaccggtaaaacggtacgtacgggttcggacgttaacgaccgtaacttacgtccgttacggtaccctttaacgtaccg

SEQ ID NO: 346711 - DNA, 593 bp, Homo sapiens
  misc_feature: GZ8MTXP02JU8NY.21.65.F10.1.454.CMB.2.raw
  modified_base (195)..(195): a, c, t, g, unknown or other
  misc_feature (195)..(195): n is a, c, g, or t
  modified_base (309)..(309): a, c, t, g, unknown or other
  misc_feature (309)..(309): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgagggganagacgcccaccctctcctgcacgggccagtcagagtgttagcagcaacttgcctcggtaccagacaagaaacctggaccacgccctcccgaggcctcctacactctatgggtcnctactcccggacgacgggcctacgtacggaactcccgagtccgtaggttcacggtcggactacggtcgggtactaggggacaggtacgtacacctctacgacctatcgagcagtccctgctaacgtntaggtaaagtttagtttagttattttactttcgngttactcgataactacgtaatcgagtcgtacgtacggtcgttacggaccgaagggtaccaagggtacaaactaccgaaaacgtagtcggtagcgtaagactaacttctacgtcgtactactcg

SEQ ID NO: 346712 - DNA, 737 bp, Homo sapiens
  misc_feature: GZ8MTXP02IBB3K.21.65.F10.1.454.CMB.2.raw
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccacctgtctgtgtctcgagggagagagcccacctctcctgcgagggccagtcaggagttgtagcagctaacgttagcctcggtaacagacaagaaacctcggaccacggcccctcccgaggtcctcctactaagttctaagttcgggtacgaccacgtaccccggccgaacggggcccctaacgtacgggtaaacccctcccggacggtaccgtacggttacgacggtacggaccgtacggttcggggtacgtacgggaactaggtaccgttacctaccgttacctaccgaacctataccgaacgaccgtacgtccgtacgtacgtacgttacgtaagttaagtttaagttttaagttaactttttagtttacgttgttacgtagttaacgtaacgtaacgtaacgtacgtacggttaccggtaccggttaccggtaccggttaccgaaaccgggtaaaacgggtaaaccggaaaagggttaacggaaaacgttaacggaaaacgttacgtacggtacggacgtaacgtacctaacgttacgttacgttaccgtttacttacgtaccg

SEQ ID NO: 346713 - DNA, 758 bp, Homo sapiens
  misc_feature: GZ8MTXP02J0PGR.21.65.F10.1.454.CMB.2.raw
  modified_base (196)..(196): a, c, t, g, unknown or other
  misc_feature (196)..(196): n is a, c, g, or t
  modified_base (310)..(310): a, c, t, g, unknown or other
  misc_feature (310)..(310): n is a, c, g, or t
tcagtcgtcgctcgcacgaccggtgctcgatttagctacgctctaaggggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagacgccaccctctcctgcgagggccagtcagagttgtagcagacaacttagcctaggtaccagcaacgaacctgccacgccctaccgacggcctcctacattctagtggtacncacgtccgaccgacgggccctacgtggaaccctcccgaacgtccgtaggttccgaggtccggaccgtacggttggggtaccgtagggactacggttacggttcctacctaccgtactaacccgtactaccgacggactccgtacccgtgtaaccgtacggttacgtacggtaaagttttagtttttaacggttaaagttttttacctttcggttcgtttaccgtacgtaaccgtaagttaaacgtaaacggtttcggaacggtttcccggggtaccgttaccggggttaccggttacccggggaaaccgtaaaacgggggaacccgttaaaacgggggtaacgtaaaacgtaaacccggtaaaaacggttacggtacggttccggaccttaacggccctaaacccgttagtttccggtttacctaccgttacttaaccgtttcccccg

SEQ ID NO: 346714 - DNA, 753 bp, Homo sapiens
  misc_feature: GZ8MTXP02J0ME4.21.65.F10.1.454.CMB.2.raw
  modified_base (196)..(196): a, c, t, g, unknown or other
  misc_feature (196)..(196): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagcccaccctgtctgtgtctccgagggganagacgcccaccctctcctgcgagggccagtcagagtgtagcagctaacttagcctaggtaccagacaagaaccgtggacccacgcccctcccgaggtccctcctacacttctagtggtcgctaccgtcccgaccgacgggccctacgtacggaacctcccgagaccgtaggttcgaggtccggacctacggttcggggtacgtaggggactacgggtcgttccaccgttcctaccaacctacgtcgaggtcccaacggtccctggaccgtaggttaccgtaaggttaaacgtttgtttttaacgggttaaactttttctttcgttacgttacgtacggtaaccgtaacggttaacaagttccggtaacggtccggttaccccggttaccggggtaccggtttaccgggaacccggtaaaacggggtaacgtaaaacgggggttaaacgaaaaccgtaaccggtaaaaccggttaggtcgggtacggtacccgtacggtaaccctaaccgttacgttacccggtttcgtttaccctttaccggtacctttacccccgg

SEQ ID NO: 346715 - DNA, 713 bp, Homo sapiens
  misc_feature: GZ8MTXP02I32J0.21.65.F10.1.454.CMB.2.raw
  modified_base (198)..(198): a, c, t, g, unknown or other
  misc_feature (198)..(198): n is a, c, g, or t
  modified_base (692)..(692): a, c, t, g, unknown or other
  misc_feature (692)..(692): n is a, c, g, or t
tcagtcgtcgctcgcacgaccggtgctcgatttagctacgctctaagggggaggaactgctcagttaggaccccagacggaaccatggaagccccagcgcagcttctcttcctcctactactctggcctcccagaaagctctggagaaatagtgatgacgcagtctccagcccaccctgtctgtgtctccgagggganagagcccaccctctcctgcagggccagtcagagttgtagcagctaacttgcctaggtaccagcaagaaacctggccagcctccaggtcctccgtacatctagtggtcgacactcccgaccgagggcccaacgtcgggaaacctccccgaacggtcccgtaagggtttcgaacggtccggacctaccgggttcggggtacgttagggggaaccctagggttcgtttacccaccgttacctaccctaaccctagtaccgaacgaccgaaccgtcccgtacggacgtacgttaccgtaaggttaacggtttagtttttaacggttaagtttttacgtttcgttacgttccgttagaccgttagttaacccgattcccgacgggttccggtccgttcgggtaaccggttccggaaccggaaacgggtaacccgtaaagggtacgaaaacgtaccgaaaacgtccgttagacgtctaccgaactaccgtacttaccgtnttcccttactactttaccccg

SEQ ID NO: 346716 - DNA, 726 bp, Homo sapiens
  misc_feature: GZ8MTXP02ILWIZ.21.65.F10.1.454.CMB.2.raw
  modified_base (195)..(195): a, c, t, g, unknown or other
  misc_feature (195)..(195): n is a, c, g, or t
  modified_base (546)..(546): a, c, t, g, unknown or other
  misc_feature (546)..(546): n is a, c, g, or t
tcagtcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccgagggganagacgcccacctctccgtgcgacgggccagtcaggtagtgttagcagactacttgcctacggtaccagacaacgaactcggccacgcctcccgaggcctcccgtacatcctagtcggtcgacctacgtccccggcccgaacggggtcccctagtaccggaaacctccccggaacgaccgttaggtccgaggttccggaccgtcggttcgggtacgtcggaactacggttcgttaccacttcctaccacccgtagtccaacgaccgtcgaccctgaccgtagttaccgttaggtaaacgtttagttttaagttaaagttttctttcgttgtttacgtagtactaacgttaanacgttccgaggttaccgggtccggttaacgggttaccggttaccgggtaaaccgggtaaacggaaccgggtaaaagggtaaggtaaaaccgtaaacgtaaaaaccggtacgttacggggtaccgaacgtacgtaacccgtacctaagttccgtagtttaccctttcgtaacctttccccg

SEQ ID NO: 346717 - DNA, 815 bp, Homo sapiens
  misc_feature: GZ8MTXP02FIMKP.21.65.F10.1.454.CMB.2.raw
  modified_base (235)..(235): a, c, t, g, unknown or other
  misc_feature (235)..(235): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgccaccctctcctgcgagggccagtcagagtgttancagcaacttcgcctggaccagcagaacctggaccacgccctacccaggcctccctacactcctagtgggtcacgacgtcccggaccggacggggtacccaacgtacgggtaaacctccccgaaggtacccgtaggggtttacgacggttcgggaccgtaacggttcgggggttacgttacggggaacttacgggtcgttacccgtaccgttacccgttaccgaaaccctacgttaccgaaacgtacccgtaccggtcccgtagggtaacccttaacgttaccgtaagggtaaacttttaacgtttttagggtttaaaacgtttttcttttacgttcgttacttcggaacttaacggttaaccctaaagttccggtaacgggtcccggtaccgggtttaaccgggtacccggtttaacgggaacccggaaaacgggggtaaaacccgggtaaacgggggttaaaaccgggaaaaacgttaaacccggaaaacgggtaaaccgggttcggtaccggtaacggtaaccctacccgtaaccgttacgttccggtttacgttaccccggtttactttaacccccg

SEQ ID NO: 346718 - DNA, 674 bp, Homo sapiens
  misc_feature: GZ8MTXP02FXJAE.21.65.F10.1.454.CMB.2.raw
  modified_base (236)..(236): a, c, t, g, unknown or other
  misc_feature (236)..(236): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagacgcccaccctctcctgcagggccagtcagtagtgttancagctaacttgccgtaggtaccagctaaacgaaaccctggacccacgcccctacccgacggtccctaccctctacttccgtaagtcggggttacaccctacgtcccccggaccgtacgggacccctaacgtacggaaaccttccccgacgtaccgtaggttcgacggtcgacctacggtcggggtcgtacggactaggtacgttccacgtcctaccacgtactcgagtccacgtccgtgactagtctaggtaaattagttttaggtaatttcctttagtcgtctaggtactacgtaatacgtacgtagtcgtccggtttaacggccggttaccggacgaaacgggtaaccgtaaagggtacgtaaaacgtaaaccggtaaaccgtagtcggtacggactcggaactacccgtatcccgttattaccgttaactccccg

SEQ ID NO: 346719 - DNA, 628 bp, Homo sapiens
  misc_feature: GZ8MTXP02IXEB2.21.65.F10.1.454.CMB.2.raw
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccgaggggagagagcccaccctctcctgcgagggccagtcagtagtgttagcagctaacttagcctggtaccagacaagaaaccgtggccagccctaccaggcctcctacactcgtatggtacncacgtcccgacgacgggccctacgtcggaactccccgagccgtaggttcaggtcgcgtacgtggggtcacggggaacngggtcttaccgactaccgtccaacgtactcgaacgcacgccctagctaggtctaggtaaatttagtttagtaaattttnttcgtagttntacggactaggttaactaacgtcgtaggtcggtccgttacggggtacttaaccgggacgaaaacggggtacgtaaaggggactaaactaaaccgaaaacggtcgtcgggtacgacttaacgaccaacttcgtcttacgttctacgttaaccg

SEQ ID NO: 346720 - DNA, 1013 bp, Homo sapiens
  misc_feature: GZ8MTXP02IDKIB.21.65.F10.1.454.CMB.2.raw
  modified_base (196)..(196): a, c, t, g, unknown or other
  misc_feature (196)..(196): n is a, c, g, or t
  modified_base (429)..(429): a, c, t, g, unknown or other
  misc_feature (429)..(429): n is a, c, g, or t
tcagtcgtcgctcgcacgaccggtgctcgatttagctacgctctaaggggggaggaactgctcagttaggacccagacggaaccatggaagcccagcgcagcttctcttcctcctgctactctggctcccagaaagctctggagaaatagtgatgacgcagtctccagccaccctgtctgtcgtctccgagggganagacgccaccctctccgtgcgacgggccagtcagagtgttagcagactaacttagccgtaggtaaccagactaacgaaaccgtcggaccaacgtccccgtaccgacggtccctccgtacacttccgtagtcggttcgcctacgtccccggcgacgggccacgtacggtaactcccgacgtccgaggttcacggtcggctacggtcgggtcgacgggactcgggtaccttaccnccgtacctaccacgtacgacgacgtcgaccgtcgtacgtacgttacgttacgttaacgtttaagttttaacgtttttaacggtttaacgtttttacgtttacggtttaccggttacgttaaccggttaacgttaaaaccgggtttaaccgttaaaccggtttaaacccgggggttttaccgggggtttaaaaccccccgggggttttaaaccccggggggttttaaacccccggggggtttaaaaccccccgggggtttttaaaacccggggggtaaaaaccccccgggggttttaaaaaccccgggggggttaaaacccggggggttttaaaaaacgggggtttaaaaaccccgggggtttaaaaaaccccgggtttaaaaaaaccccgggggtttaaaaacccgggggttttaaccccgggggtttaaaaccgggggttttaaccccggggttaaaccccggggttttaaaccccggggttaaaacccccggtttttaaaccccggttttaacccgggttttacccggtttttaacccccggtttttaccccgtttaaacccccgggttttaaaccccccgg

SEQ ID NO: 346721 - DNA, 755 bp, Homo sapiens
  misc_feature: GZ8MTXP02JQSSJ.21.65.F10.1.454.CMB.2.raw
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagtcgtcgctcgcacgaccggtgctcgatttagctacgctctaagggggaggaactgctcagttaggacccagacggaaccatggaagccccagcgcagcttctcttcctcctgctactctggctcccagaagctctggagaatagtgatgacgcagtctccacgccctacctgtcctgtcgtctccgaggggagacgacgcccacccttcctccgtgcgacgggccaggtcaggtagtgttacgcagtactaacttacgccgtacggtaccagaccgaacgtaaacccgtcggacccacgtccccctacccggacggtcccctacccctactacgttaccttagtcgggtctaccgaccgtcccggaccggaccggtaccccgtaacgtacggaaccttcccgaagtcccgtaggttaccgaggtcgaccgtacggttcggggtcgacgggactcggtactaccgacttacccncgtaaccgtacacgaccncgacccggtactacgtacgttcgttaacgtaggttaacgttttagtttaacgttaacgtttttcgttacgggtactttacggtaacgtaccgtaaagtacgtacgttacgggtacggtcccggttaccggttaccgggtaacccggttacgggaaaccccgtaaggggtaaacgttaacgggtaaacgtaaaccgtaacgtaaacggtacggtgtaccgtcgaacgtaccctacgtcgttacgttctttaccgtacctcg

SEQ ID NO: 346722 - DNA, 498 bp, Homo sapiens
  misc_feature: GZ8MTXP01CS8EQ.8.12.B01.1.454.CMB.2.raw
  modified_base (316)..(316): a, c, t, g, unknown or other
  misc_feature (316)..(316): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctctggagataaattgggggataaatatgcttgctggtatcagcagaggccaggccagtcccctgtactggtcatctatcaagataacaagcggccctcagggntccctgagcgattctctggctccaactctgggaacacagccactctgaccatcagcgggacccaggctacggatgaggctgactattactgtcaggcgtgggacagcagtcacctagtggtggtttcgggcggagggaccaaggcgttgaccgtctggtcagcccaagtccgttcgtccccg

SEQ ID NO: 346723 - DNA, 491 bp, Homo sapiens
  misc_feature: GZ8MTXP01C26K4.8.12.B01.1.454.CMB.2.raw
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggcctcagggatccctgagcgattctctggctccaaactctagggaaacacagccactctgaccatcagcgggaccaggctacggatgagctgactattacgtgtacgaggcgtgggacagcagcacctagtgtggtttcggnggaggacaagcgcgaccgtctggtcngccacgtcgcgtccccg

SEQ ID NO: 346724 - DNA, 499 bp, Homo sapiens
  misc_feature: GZ8MTXP01AJ5AH.8.12.B01.1.454.CMB.2.raw
  modified_base (476)..(476): a, c, t, g, unknown or other
  misc_feature (476)..(476): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggaataaatatgcttgctggtatcagcagaggccaggccagtcccctgtactggtcatctatcaagataacaagcggccctcagggatccctgagcgattctctggcctccaaactcgtagggaacacacgccactctgaccatcagcggacccaggctacggatgagctgactatactgtcaggcgtgggacagcagcactgtgtggtttcggcggaggaccgaagcgttcgaccgtctggtcncgcccgaggccgttcgtcccccg

SEQ ID NO: 346725 - DNA, 597 bp, Homo sapiens
  misc_feature: GZ8MTXP01DX7PR.8.12.B01.1.454.CMB.2.raw
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtaatcagcagaggccaggccacgtcccctgtactggtcatctaatacaagataaacgaagccggaccctcgagggactcccgtgagcgtattctctggcttccaactcgtagggaacacgngccactctagaccanacgacgacgggacccaggtctacggatcgaaggctacggacgttattacgtgttcgaagggcgtacggggacaagctaacggacctaccgtagtggtttcggggttttaccgggcggggaacgggaaccgaacggttacgttccggttaacccggttcccgttagggtcccgtacggaccccgaaagggtcccgttccggtcccccccgg

SEQ ID NO: 346726 - DNA, 498 bp, Homo sapiens
  misc_feature: GZ8MTXP01ACEYW.8.12.B01.1.454.CMB.2.raw
  modified_base (312)..(312): a, c, t, g, unknown or other
  misc_feature (312)..(312): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctnagggatccctgagcgattctctggctccaactctagggaacacagccactctgaccatcagcggaccaggctacggatgagctgactatactgtcaggcgtgggacagcagcacctagtggtggtttcgggcggacgggacgaagcgttcgaccgtcgtgtcgcgcccgaggtccgttcgtccccg

SEQ ID NO: 346727 - DNA, 513 bp, Homo sapiens
  misc_feature: GZ8MTXP01AJIFN.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggcaggccagtcccctgtactggtcatctatcaagataacaagcgcctcgagggactcccgtgagcgattcctctcggctccaaactcgtagggaacacacgccactctgaccatcgagccggaccgaggctacggagtgaggctgacttagttacgtgtacgaggcgtggacgagcagacacctagtcgtggtttcgggcggaggaccgaagcgttcgaccgttcctggtcacgccgagtccgcgtcccccg

SEQ ID NO: 346728 - DNA, 516 bp, Homo sapiens
  misc_feature: GZ8MTXP01BV5C1.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggaccctcgagggactccctgagcgattctctggcctcaactcgtgggaacacacgccactctcgaccatcacgcggaccccagggctacggatgaacggctgacgtattactgtccgaggccgtggacagcagcaccgtagtggttggtttcgggcggttagggacccaagcgttggacccgtcttggcagcccaaggcgttcgcccccg

SEQ ID NO: 346729 - DNA, 506 bp, Homo sapiens
  misc_feature: GZ8MTXP01ERKL8.8.12.B01.1.454.CMB.2.raw
  modified_base (484)..(484): a, c, t, g, unknown or other
  misc_feature (484)..(484): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggccctcagggactcccgtgagcgattctctcggctccgaaactcgtgggaacacagccactctgaccatcacgcgggacccaggctacggatgaggctgacgtattactgtcaggcgtggacagcagcacctagtgtggtttcggcggaggaccgaagcgttgacccgtcgtggtcncgccgaggtccgttcgtccccg

SEQ ID NO: 346730 - DNA, 490 bp, Homo sapiens
  misc_feature: GZ8MTXP01CQT0Y.8.12.B01.1.454.CMB.2.raw
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (431)..(431): a, c, t, g, unknown or other
  misc_feature (431)..(431): n is a, c, g, or t
  modified_base (456)..(456): a, c, t, g, unknown or other
  misc_feature (456)..(456): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataaatatgcttgctggtatcagcagaggccaggccagtcccctgtactggtcatctatcaagataacaagcggccctcaggggatccctgagcgattctctcggctccaactctgggaacacagccactctgaccntcagcggacccaggctacggntgaggctgactatactgtcaggcgtgggacagcagcactntgtggtttcggcggagggaccagcngaccgtctggtcagcccaaggtccttcgtccccg

SEQ ID NO: 346731 - DNA, 535 bp, Homo sapiens
  misc_feature: GZ8MTXP01B8C7Z.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataaatatgcttgctggtatcagcaggaggccaggccacgtcccctgtactggtcatctatacaagataacaagcgcctcgaggactccgtgagcgtatctctcggctcaactcgtagggaacacacgccactctacgaccatcgacgcgggacccagggactacggagtgaggctacgtaacttattacgtgtacgaggccgtgggacagcacgcgtacctgtcggttggtttcggggcggacgggacgaagcgttgacccgttcgtcggtccgacgcccgacggtcccgttcgtcccccg

SEQ ID NO: 346732 - DNA, 519 bp, Homo sapiens
  misc_feature: GZ8MTXP01BJT4T.8.12.B01.1.454.CMB.2.raw
  modified_base (334)..(334): a, c, t, g, unknown or other
  misc_feature (334)..(334): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggccctcagggactccctgagcgattcnctggctcaactctagggaacacacgccactctgaccatcacgcgggacccaggctacggatgaggctgacgtattacgtgtacgaggcggtgggacagcagcaccgtatggttgggtttcgggcggttacgggaccgaagcgttcgaccgttccgtggtcgcgcccgaggtccgttcgtcccccg

SEQ ID NO: 346733 - DNA, 513 bp, Homo sapiens
  misc_feature: GZ8MTXP01DQHDV.8.12.B01.1.454.CMB.2.raw
  modified_base (383)..(383): a, c, t, g, unknown or other
  misc_feature (383)..(383): n is a, c, g, or t
  modified_base (452)..(452): a, c, t, g, unknown or other
  misc_feature (452)..(452): n is a, c, g, or t
  modified_base (494)..(494): a, c, t, g, unknown or other
  misc_feature (494)..(494): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatacaagataacaagccggccctcgaggactccctgacgcgattctcgtcggcctccaactcgtagggaaacacagccactctagacctancgacggccggaacccacgggctacggagtgagctgactattactgacgaggcgtggacagcagcacgtntgtggtttcggcgggaggacgagacgttcgaccgtcgtgtcncgccaggtcgccgtccccg

SEQ ID NO: 346734 - DNA, 494 bp, Homo sapiens
  misc_feature: GZ8MTXP01EB6KE.8.12.B01.1.454.CMB.2.raw
  modified_base (429)..(429): a, c, t, g, unknown or other
  misc_feature (429)..(429): n is a, c, g, or t
  modified_base (476)..(476): a, c, t, g, unknown or other
  misc_feature (476)..(476): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttaccgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaaagataacaagcggccctcagggatccctgacgcgattctctggctccaactctgggaaacacagccactctgaccatcagcgggacccaggctacggatgagctagactattactgtcgaggcgtggacagacngcacctatggtggtttcggcggagggacgaagcttgcgttcgtgtcncgccagctcgccccgtcg

SEQ ID NO: 346735 - DNA, 577 bp, Homo sapiens
  misc_feature: GZ8MTXP01CJVX0.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatcaagataacgaagcggccctcgagggactccctgagcgtattctcgtcggcctccaactcgtagggaacacacgaccactctgaccatcgaggcccgggaccgagggactacggagtgaggctagtacttagtttacgtgttacgaggccgtgggacacgcacggctaaccgttagtggtttcgggtttccgggcggttaacggggaaccctaaggttccgttcggttacccggttctacgggtcaccggtaccccgaaggggtccttaacccggtccccccg

SEQ ID NO: 346736 - DNA, 684 bp, Homo sapiens
  misc_feature: GZ8MTXP01BRDL3.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctggagataagtggggataatatgcttgctggtatcagcagacggcaggccacgtcccctgtactggtcatctatacaagataacagcgccctgaggactccgtgagcgattctctcggcctccaaactcgtagggaacacacgccactctgacctatcgacggcccgggaacccgacgggacgttaaccgggattacgggacgggtacttacggtaacttaaacgtttacgttacgggttacccgaaaggggtcccgggttacgggggaaccaacgggaccgaacgggtacccttaaacccgttaaggttcggggttttcgggggtttttcccggggaaccgggggttaacgggaaacccgtaaagggttcccggttaccgggttaaccccggtttcccggtttacgggttaacccgtaccgggaccccgttaaacgggggtccccttcccgggttcccccccggg

SEQ ID NO: 346737 - DNA, 589 bp, Homo sapiens
  misc_feature: GZ8MTXP01D6NPU.8.12.B01.1.454.CMB.2.raw
  modified_base (383)..(383): a, c, t, g, unknown or other
  misc_feature (383)..(383): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataatatgcttgctggtatcagcagaggccaggccacgtcccctgtactggtcatctatacaagataacaagccggccctacgagggactcccgtgacgcgtattctcgtcggcctccaaactcgtacgggacacacgccactctgaccancgaggaccgggacccgaggcgtaaccggagtggaggtcgtagacttattacgtgtacgaggcgtgggacagctatctaaccgttgtcgggtttcgggttttcggggacgggttacgggaaccgtaacggttcgttccggttacccggttccgttcgggttaacccgacggaccccggttaacggtcccgttcccgggtccccccgg

SEQ ID NO: 346738 - DNA, 499 bp, Homo sapiens
  misc_feature: GZ8MTXP01D6ALX.8.12.B01.1.454.CMB.2.raw
  modified_base (312)..(312): a, c, t, g, unknown or other
  misc_feature (312)..(312): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
  modified_base (478)..(478): a, c, t, g, unknown or other
  misc_feature (478)..(478): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcgccctnagggatcctgagcgattctctacggctccaactcgtacgggaacacacgccactctgaccatcagcgggaccaggctacggatgaggctgactattactgtnaggcgtggacagcagcaccgtntgtcggtttggcgggaggacaagcgttcgaccgttcgtgtcncgccgaggtccttcgtccccg

SEQ ID NO: 346739 - DNA, 489 bp, Homo sapiens
  misc_feature: GZ8MTXP01BH2PX.8.12.B01.1.454.CMB.2.raw
  modified_base (312)..(312): a, c, t, g, unknown or other
  misc_feature (312)..(312): n is a, c, g, or t
  modified_base (473)..(473): a, c, t, g, unknown or other
  misc_feature (473)..(473): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctnagggatcccctgagcgattctctggctccgaaactctagggaacacagccactctgaccatcagcgggacccaggctacggatgagctgactattactgtcgaggcgtgggacagcagcacctatgtggtttcggcggaggaccagcgttcgacgtctgcngccaggcttcgccccg

SEQ ID NO: 346740 - DNA, 563 bp, Homo sapiens
  misc_feature: GZ8MTXP01D3FT9.8.12.B01.1.454.CMB.2.raw
  modified_base (318)..(318): a, c, t, g, unknown or other
  misc_feature (318)..(318): n is a, c, g, or t
  modified_base (434)..(434): a, c, t, g, unknown or other
  misc_feature (434)..(434): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccaggccacgtcccctgtactggtcatctatcaagataacaagcgcctcgaggntccctgagcgattctctcggctccaactcgtcgggaaacacacgccacgtctcgaccatcgagccgggaacccaggctaacggatgaggctagacttattacgtgtcgaaggtcgngggacagcagcaccgtagttggttacgggttttcgggacgggacgggaaccgaacggttcgttcggttaacccgttccggttacgggtccgaccggacccggaacggtccgttccgtaacccccccggg

SEQ ID NO: 346741 - DNA, 531 bp, Homo sapiens
  misc_feature: GZ8MTXP01EILXK.8.12.B01.1.454.CMB.2.raw
  modified_base (453)..(453): a, c, t, g, unknown or other
  misc_feature (453)..(453): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctctggagataaattgggggaataaatatgctgctggtatcagcagaggccaggccagtcccctgtactgtcatctatacaagataacaagcggcctcgagggactccctgagcgtattctcgtcggctccaaactcgtacgggaaacacgagccaactctcgaccatccgaggccgggaacccgacgggaccgtaaccgggagtgaacgggctaggactatttaacgtgtacgaggtcgngggacagcatcactagtcgtggtttcggcggaggacgaagcgttcgaccgtcgttgcgagccgagccgttcgtccccg

SEQ ID NO: 346742 - DNA, 558 bp, Homo sapiens
  misc_feature: GZ8MTXP01BZWKU.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcgagggatcccgtgagcgattctctggcctccaactctgggaacacagccactctgaccatcagcgggacccaggctacggatgaggctagacgtattaacgtgtcgaggacggtgggacgacgcgacggcacccgttagtggttgggtttttcggggcgggttacggggaaccgaaggccgttcggttacccggttccgttcgggttccgacggccccgaaggggtcccgttccggttccccccgg

SEQ ID NO: 346743 - DNA, 694 bp, Homo sapiens
  misc_feature: GZ8MTXP01EW30C.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtacgtgtcatctatacaaagaataaacaagccggccctacgagggtactcccgtaggagcgtattctcgtacgcctcccaaacgtcgacggggaaacaccgacgccctaactctacgaacccagtcgacggaccgggaaccccagggtacctaacgggagtacgggacggtactacggtaacttaacgtttaacgttcggtaccgaaggggtccggtagggggaaaccagggaccaacggtaccctaaccgtttaaggttaacgggttttcgggggttttaccgggggaccgggggaaacggggttaaccccgaaaagggttcccgtttacggttaaccccgggtttccgtttacgggtaaccgaacccggggtaccccgaaccggggtccccgttccccgggttcccccccgg

SEQ ID NO: 346744 - DNA, 530 bp, Homo sapiens
  misc_feature: GZ8MTXP01BC9QS.8.12.B01.1.454.CMB.2.raw
  modified_base (401)..(401): a, c, t, g, unknown or other
  misc_feature (401)..(401): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctaatcaaagataaacaagcggccctcagggatccctgagcgattctctggctccaaactcgtagggaaacacacgccactctagaccatcagcgggacccaggctacgggangagctagactatacgtgtacgaggcgtggacagcgacgactacgtgtggttcgggttcgggacgggacggaacgtaagcgttcggttaccgttcgtcggcgacgacccgacggtccgttcccgtccccg

SEQ ID NO: 346745 - DNA, 501 bp, Homo sapiens
  misc_feature: GZ8MTXP01DNEMW.8.12.B01.1.454.CMB.2.raw
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggcctcgagggatccctgagcgtattctctggctccaaactcgtagggaacacgagccactctcgaccatcgacgaccgggaccgacggctacggatagagctagactattactgtacgaggcgtgggacagcagcactagtgtggtttcggcgaggacagcgttgaccgtctgtcncgccgagtcncgtccccg

SEQ ID NO: 346746 - DNA, 585 bp, Homo sapiens
  misc_feature: GZ8MTXP01AK60I.8.12.B01.1.454.CMB.2.raw
  modified_base (394)..(394): a, c, t, g, unknown or other
  misc_feature (394)..(394): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacgaagcggccctacgagggactccccgtagacgcgtacttctcgtacgggcctcccaaactcgtagggaaccacgacgaccactctcgaccancgacggcggacccgaggctacggagtgaaggctagacgttattacgtgtcgtaggcgtgggacaggctatccctactacgtggttcggggttttcgggcgggttaacgggaccgaaggttccgttcggttaccccggttccgttacggtccgaccggccccgaacgggtcccgttccggttcccccccggg

SEQ ID NO: 346747 - DNA, 734 bp, Homo sapiens
  misc_feature: GZ8MTXP01A3CK3.8.12.B01.1.454.CMB.2.raw
  modified_base (293)..(293): a, c, t, g, unknown or other
  misc_feature (293)..(293): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagagccaggccacgtcccctgtactggtcatctancaaagataacgaagccggaccctacgagggactcccgtggaacgcgtaacttcctcgtcgggtacccttccgaaaccgtccgtaacggggaaaccaaccgaacggtaccccaaaccttccgtacgaaccctaacgtacccgaacgggacccgggggaaacccccgagggacccgttaaacgggacgttcggaaacggggtccttaggtaacttaacgtttaaccgtcggttaccgaaggggtcccggtaggggaaccaacgggcctaaacggtaaacccgttgttaacggggttcggggttttaacggggacggggtaaaccgggggaaccctaacgggtacccgttacgggttccccggtttaccgtttcgggggtacccctaacgggtaccccccggaagggttccccgttcccgggttcccccccgtttaacccgggg

SEQ ID NO: 346748 - DNA, 628 bp, Homo sapiens
  misc_feature: GZ8MTXP01EEGKG.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggcaggccagtcccctgtactggtcatctatcaagataacaagcggcctcgagggactcccgtgagcgtatctctcggcctccaactcgtacgggaacacacgccactctgaccatcgacggcgggaacccgaggacgtacggggatcggacggtactagtaccgttaatttaaccgtggttccgagggtcggtagggaccgaaggccgacggactacccgttaggttcgggtttcggggtttttaccggggaccggggttaaacggggtaacccgaaacggttccggttacgttaccccggggttccgtttacgggttaaccgacgggaccccgaacgggtcccgttccccgggttcccccccggg

SEQ ID NO: 346749 - DNA, 505 bp, Homo sapiens
  misc_feature: GZ8MTXP01EZRFF.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcactaggatccgtggcctcctatgagctgactcagccaccctcagtgtccgtgtccccaggacagacagccaggatcacctgctctggagataaattgggggataaatatgcttgctggtatcagcagagccaggccagtcccctgtactggtcatctatcaagataacaagcggccctcagggactcccgtgacgcgattctcgtggctccaaactcgtagggaacacacgccactctgaccatcagcgggaccaggcacggatgagctagacgtattacgtgtcgaggcgtgggacagcagcacctatcggtggtttcggcggttagggaccaagcgttgaccgtctgtcacgccaggtcgttcgtccccg

SEQ ID NO: 346750 - DNA, 575 bp, Homo sapiens
  misc_feature: GZ8MTXP01EO2RZ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggaataaatatgcttgctggtatcagcagaggccaggccagtcccctgtactggtcatctatacaagataacaagccggccctacgagggactcccgtgagcgtattctcgtacggcctccaacttcgagggaacacacgccactctacgaccatcgacgccgggaacccgaggctacgggatcgaggtctaggacgttattaccgtgtaccgagggtcggtaggggacaggccagtacctaccgttagtgggtttcgggtttcgggacgggttacgggaaccaaggttcgttcggttaccggttccgttgggtccacggcccgaaggtccgttccgtcccccg

SEQ ID NO: 346751 - DNA, 588 bp, Homo sapiens
  misc_feature: GZ8MTXP01EMN7P.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaatgggggataaatatgctgctggtatcagcagaggccaggccagtcccctgtactggtcatctatacaagataaacaagccggacctcgagggactcccgtgacgcgtattctcgtcggctccaaactcgtacgggaacacacgccactctgaccatcacggcggacccaggctaacgggatcggaacggtctacggtaacttaagttaacgtcgttacgagggcggtacggggacaggcgtagccgtaccgttaagtggttcgggttttacgggccgggaaggggacccgaaacggttcgttcggttacccgggtcgtttcggccgacggcccgttaacggggtcccttccggtccccccgg

SEQ ID NO: 346752 - DNA, 506 bp, Homo sapiens
  misc_feature: GZ8MTXP01ACT2V.8.12.B01.1.454.CMB.2.raw
  modified_base (362)..(362): a, c, t, g, unknown or other
  misc_feature (362)..(362): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggcctcagggatccctgagcgattctctggctccaactcgtgggaacacgagccacnctgacatcagcggacccaggctacggatgagctgactattacgtgtcgaggcgtggacagcagcacctagtggtggtttcgggcgggttagggaccgaagcgttcgaccgtcgttcggtcgacgcccgaggtccttcgtccccg

SEQ ID NO: 346753 - DNA, 680 bp, Homo sapiens
  misc_feature: GZ8MTXP01DZSMB.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccaggccacgtcccctgtacgtggtcatctatacaagataacaaagcggaccctcgagggactcccgtagacggcgtactttcctcgtacgggcctccctaaactccgtacgggaaaccacgacgcctactctagaaccatcgaacggacccgggaacccgagggactaaccgggatacggaaggtccgtaggtaactttaacgtttaaccgttcgggttacgacggggtacccgggttggggggaacaaacgggccaacgggccttaacccgttaaggttgggttttcgggggtttttcggggaccgggggttaaaggggtaacccccgaaagggttccgttcggaaaccccggtttccgttacgggtaacccgacggccccgttaaagggtccccgttccggttccccccccgg

SEQ ID NO: 346754 - DNA, 529 bp, Homo sapiens
  misc_feature: GZ8MTXP01AVEYN.8.12.B01.1.454.CMB.2.raw
  modified_base (503)..(503): a, c, t, g, unknown or other
  misc_feature (503)..(503): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaatgggggataaatatgcttgctggtatcagcagaggccaggccagtcccctgtactggtcatctatcaaagataacaaagcggaccctcgaggggactccctcggagcgtattctcgtgggcctccaaactcgtagggaacacagacccactctgaccatcgacggcggacccaggctacggatgaggctgacgtatacgtgtgaggcgtgggacagcagcacctatcggtggtttcgggcggacgggacgtaagcgttcggacccgtcgtcggtccncggacccacggccgttcggtcccccg

SEQ ID NO: 346755 - DNA, 529 bp, Homo sapiens
  misc_feature: GZ8MTXP01BW12R.8.12.B01.1.454.CMB.2.raw
  modified_base (314)..(314): a, c, t, g, unknown or other
  misc_feature (314)..(314): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatacaagataacaagcggccctnagggactccctgagcgattctctggcctccaactcgtagggaacacacgaccactctcgaccatcacgcgggacccaggctacggatgagctgactattactgtacgaggcgtgggacaggctatcacctagtggttgggttttcgggcgggttaggaccgaaggccgttcggacccgtcgttggtccacggcccgaggtccgttccgtcccccg

SEQ ID NO: 346756 - DNA, 502 bp, Homo sapiens
  misc_feature: GZ8MTXP01BV7G6.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggcctccaactctgggaacacagccactctgaccatcagcgggacccaggctacggatgaggctgactattacgtgtcgaggcgtgggacagcagcacctatggtggtttcggcggttaggaccgaagcgttggacggtcgtggtcacgccgaggtcgttcgtccccg

SEQ ID NO: 346757 - DNA, 685 bp, Homo sapiens
  misc_feature: GZ8MTXP01BE1TY.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataatatgcttgctggtatcagcagaggccaggccagtcccctgtactggtcatctatacaagataaacaagccggccctcgacgggactcccgtggacgcgattcctcgtcggcctccaactcgtagggaaccacgacgcctactctacgaccatcgaacggcccgggaacccgacgggacgtaacgggacgtacggacgggacttacgggaactttaacgtttacgtacggtacgtacggggcggttacgggggaccgaacggtactaacgtaccctaacccgttaaggttcggtttacgggggtttttccgggggacggggttaaccggggtaacccggtaaacggttcccggttacgggttaaccccggtttcccggtttaccggggttaaccggacccggaccccggttaaaccgggtccccggttccccgggttccccccccggg

SEQ ID NO: 346758 - DNA, 667 bp, Homo sapiens
  misc_feature: GZ8MTXP01DPWNA.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatacaaagataacaagccggccctacgaggggactccccgtggacgcgatttcctcgtcgggacctcccaaactccgtagggaaaccacgacgacccactctcgaccacgtcgacggacccgggacccagggacctaaccgggatacggaacgggctacggtaacttacgtttaaccgtggttaccgaagggtccggtaggggaaccgaacggaccgtacggaccctaacccgttaaggttcgggtttcggggttttaccgggggaccggggaacggggaacccgaaacggttccgttcgggttaaccccggtttccggttacgggttaaccgaccggtaccccgaacgggtccccgttcccggttcccccccgg

SEQ ID NO: 346759 - DNA, 520 bp, Homo sapiens
  misc_feature: GZ8MTXP01B4LMM.8.12.B01.1.454.CMB.2.raw
  modified_base (331)..(331): a, c, t, g, unknown or other
  misc_feature (331)..(331): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattcnctggctccaactctgggaacacagccactctgaccatcagcggacccaggctacggatgagctgactagttactgtcaggcgtggacagcagcacctagtgtggtttcggcggttacgggaccgaaggcgttcggacccggttccgttcggtaaccgcggcccgaaacgggtccgttcggtcccccccg

SEQ ID NO: 346760 - DNA, 561 bp, Homo sapiens
  misc_feature: GZ8MTXP01DNCPC.8.12.B01.1.454.CMB.2.raw
  modified_base (387)..(387): a, c, t, g, unknown or other
  misc_feature (387)..(387): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggaataaatatgctgctggtatcagcagagccaggccagtcccctgtactggtcatctatacaagataacaagcgacctcgacgggatcccgtggacgcgtattcctcgtcggcctccaaactcgtacgggaacacgacgccaactctacgaccanaccgaggcccggaaccccgacgggacgtaaccggagtggaacggctaggtaacctaagtttactgtacgaggccgtggacacgcaaggcctacgtagtggttcggtttcggcgggaggaccgtaagccgttcgaccgttcgtcggtcgacgcccgaagtccgttccgtcccccg

SEQ ID NO: 346761 - DNA, 659 bp, Homo sapiens
  misc_feature: GZ8MTXP01B64AN.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataaatatgctgctggtatcagcagaggccaggccacgtcccctgtactggtcatctatacaagataaacagcgcctcgaggactccgtgagcgtattcctcgtcggcctccaaactcgtacgggaaacaccacgacccaactctacgaccagccgaacggccgggacccagggactacgggatggacggcgtagtaacctagttaacgtcggtacggaacgggccggtaggggacaacggcgtaaacggccctaaacccgttggttcggggtttcgggggttttccggggaaccgggggttaaacggggtaaccccgaaacgggttccgttccgggttaaccccgggtttcccggttacggggttaacccgaacccgggtacccccgaaacgggggtcccctttccccgggtccccccccccggg

SEQ ID NO: 346762 - DNA, 671 bp, Homo sapiens
  misc_feature: GZ8MTXP01EN0SU.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctctggagataaagttggggataaatatgcttgctggtatcagcaggaggccaggccacgtcccctgtactggtcatctatacaagataacaagcgcctacgagggactcccgtgacgcgtattcctcgtacggcctccgaactcgtacgggaacacgacgcctactcgtacgaaccagtacgacggaccggggaaccccgagggtaccgtaacgggagttacgggaacggtaccgttacggtaactttaacgtttaacgttcggttaccggaacggggtccgggttacgggggaacctaacgggaccgaacgggtacccttaacccgttaaggttcggggtttcgggggttttacccggggacggggttaaccgggaaccgtaaacggttccgttcggttacccggttccgttacgggtccgaccggacccgaacgggtcccgttcccggtcccccgg

SEQ ID NO: 346763 - DNA, 622 bp, Homo sapiens
  misc_feature: GZ8MTXP01AR35J.8.12.B01.1.454.CMB.2.raw
  modified_base (445)..(445): a, c, t, g, unknown or other
  misc_feature (445)..(445): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagtggggaataatatgcttgctgtatcagcagacggccaggccacgtcccctgtactggtcatctatacaagactaacgaacgccggcctacgaggactcccgtgacgcgtatctcgtacggcctccaactcgtacgggaaccacgacgcactctacgaccatcgacgcggacccgaggacgtacggatcggacgtctagtacttaattacgtggtaccgngggtcggtgggaacacggcgacggaccttaccgttagggttcgggtttcgggggtttaccggggacggggacgggtaaacccgtaagggttcccgttacgggttaccccggtttccgggttacgggtcccgaacccgggtacccgaaccggggtcccgttcccgggttcccccccgg

SEQ ID NO: 346764 - DNA, 539 bp, Homo sapiens
  misc_feature: GZ8MTXP01BA3P8.8.12.B01.1.454.CMB.2.raw
  modified_base (329)..(329): a, c, t, g, unknown or other
  misc_feature (329)..(329): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataaatatgcttgctggtatcagcagaggccaggccagtcccctgtactggtcatctatcaagataacagcggcctcgaggctccctgagcgattcnctggcctccaaactcgtagggaacacacgccaactctgaccatacgacgccgggaacccgaggaccgtacggatgaggctggacttagttaccgtgtaccgaggtccggtggacagactacgtcaccgttagtcggttggtttcgggcggttagggaccgaagcgttcgttaccgtccttgggtcacgccgacggccgttccgtcccccg

SEQ ID NO: 346765 - DNA, 715 bp, Homo sapiens
  misc_feature: GZ8MTXP01CENEY.8.12.B01.1.454.CMB.2.raw
  modified_base (387)..(387): a, c, t, g, unknown or other
  misc_feature (387)..(387): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataaatatgcttgctggtatcagcagaggccaggccacgtcccctgtactggtcatctatcaagataaacaagcggacctcgagggactcccgtgacgcgtattctcgtgggcctccaactcgtagggaacacgacgccaactctacgacctanccgacggaccggggaaccccgagggaccgttaaccgggagttacgggaaacgggtcttacggtaaccggtttaacgtttaaaccgtcgggttaccgaaacgggggtccgggttaacgggggaccgtaaacggtccggaaacggggtcccttaaaacccggtttaggttcgggggtttttacggggtttttccgggggaaccgggggttacgggggaaacccgtaaacgggttcccgtttaccggggttaaccccgtttcccggtttcgggttaacccgtaccgggacccccgaaacggggtccccgttcccggtttcccccccccggg

SEQ ID NO: 346766 - DNA, 653 bp, Homo sapiens
  misc_feature: GZ8MTXP01EQPGJ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatcacctgctctggagataaagtggggaataaatatgcttgctggtatcagcagacggccaggccacgtcccctgtactggtcatctatacaaagaataaaccgaagccggccctacgacgggtactcccgtagacggtacgtatttccgtcgtacggacctccgaaactccgtagggaaaccaccgacgccctactctacgaccagcgacggaccggggaaccccgagggtaccgtaacgggagtcgggaacggtacgttacggtaaccgtttaattacgtcggtacggacgggtccgtacggggacaacggcaacggtacctaccgttaggtcgggtttacgggtttcggggaccgggaacgggaaccgtaaggttccgttcggttacccggttaaccgtgggtaaccaccgggacccgaacggtcccgttccggtccccccg

SEQ ID NO: 346767 - DNA, 503 bp, Homo sapiens
  misc_feature: GZ8MTXP01EWLL6.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaatgggggataaatatgcttgctggtatcagcagaggccaggccagtcccctgtactggtcatctatacaagataacaagcggcctcagggatccctgagcgattctctggctccaaactctgggaacacagccactctgaccatcacgcgggaccccaggcgtacgagtgaggctgacgtattaactgtcaggcgtgggacagcagcaccgtatgtggtttcgggcggttagggaccgaagcgttgaccgtctggtcaggccaggtcgttcgtccccg

SEQ ID NO: 346768 - DNA, 582 bp, Homo sapiens
  misc_feature: GZ8MTXP01B6HJZ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtcccaggacagacagccaggatcacctgctctggagataagtggggaataatatgcttgctggtatcagcagaggccaggccacgtcccctgtactggtcatctatacaagataacaagccggccctacgacgggactcccgtagacgcgtattcctctgggcctccaaactcgtagggaaaccacgacgcccaactctagaccatccgagaccgggaccccagggacctacgggatgacggctagacttattacgtgtacgaggtcgtaggacaacggctaaggacctacccgtagttcgggtttcgggtttcgggcgggacgggaacgtaacgccgttcggacccgttccgttcggaacgaccggacccgaacggtccgttcccgggtccccccg

SEQ ID NO: 346769 - DNA, 493 bp, Homo sapiens
  misc_feature: GZ8MTXP01BE5QG.8.12.B01.1.454.CMB.2.raw
  modified_base (424)..(424): a, c, t, g, unknown or other
  misc_feature (424)..(424): n is a, c, g, or t
  modified_base (447)..(447): a, c, t, g, unknown or other
  misc_feature (447)..(447): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactcgtgggaacacagcactctgaccatcagcggacccagactacggatgagactgacgtattactgtcgaggcgtggacagnagcacctatgtggtttcggcggnggaccaagcgttgaccgtctgtcacgccgttaacggcttcgccccg

SEQ ID NO: 346770 - DNA, 632 bp, Homo sapiens
  misc_feature: GZ8MTXP01BF21L.8.12.B01.1.454.CMB.2.raw
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (482)..(482): a, c, t, g, unknown or other
  misc_feature (482)..(482): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccaggccacgtccccngcncgtcgtacactactatacgaagaactaaacgacgccgccacgacggacctccccgtagacgtacgtacttctcgtcgtccctacctaactcggtacggaacacgacgaccctactcgacgacctacgaccgacgggacccggaaccgtaggaccgtaacggagtacggacgtacgttacggtaactttacgttaaccgnggtaccggagggtcggtaggaacgagtaccgacgtccgtaacgtaaggttcgggtttacggggttaccgggacggggaacgggtaacttacggcgttaccggtaaccgttccggttcgaccgaccgacccggtaacggttccgtccccgg

SEQ ID NO: 346771 - DNA, 544 bp, Homo sapiens
  misc_feature: GZ8MTXP01AJJPK.8.12.B01.1.454.CMB.2.raw
  modified_base (485)..(485): a, c, t, g, unknown or other
  misc_feature (485)..(485): n is a, c, g, or t
  modified_base (519)..(519): a, c, t, g, unknown or other
  misc_feature (519)..(519): n is a, c, g, or t
tcagctcgcgtgtccacgaccggtgctcgatttagtagtgtagattccgcggggctgggcctcaggaagcagcatcggaggtgcctcagccatgacatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcgccctcgaggactcccgtgagcgattctctggcctccaaactcgtagggaacacacgccactctacgaccatcgacggccgggaccccagggcctaacgggatggaaggtcctaggaccttagttaccgtgtaccgaagggtcgtgggacaggcacgctacctagtgtgggtttcgggnggacgggaccaagcgttcggaccgttcgttggcncgacccgaggtccgttcgtcccccg

SEQ ID NO: 346772 - DNA, 571 bp, Homo sapiens
  misc_feature: GZ8MTXP01BY540.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataatatgcttgctggtatcagcagagccaggccacgtcccctgtactggtcatctatcaagataacagcgcctcagggactcccgtgagcgtattctcgtcggcctccaactcgtagggaacacacgccactctacgaccatcgacggccgggaacccgaggcctacggatcgacggctacgacttacgttacgtggtacgaagggtcggtacggggacaaggcagacctaccgtagtggttcggggtttcgggcggggacgggaaccgaggttccgttcggacccgtttccgttcgggtcctacggcccgaacgggtcccgttccggtccccccgg

SEQ ID NO: 346773 - DNA, 670 bp, Homo sapiens
  misc_feature: GZ8MTXP01DNP97.8.12.B01.1.454.CMB.2.raw
  modified_base (205)..(205): a, c, t, g, unknown or other
  misc_feature (205)..(205): n is a, c, g, or t
  modified_base (257)..(257): a, c, t, g, unknown or other
  misc_feature (257)..(257): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcagancacctgctctggagaataaagtgggggaataaatatgcttgctggtatcagngaggacgcgacgctaccgtccgtagtagtcgtactatactaactaacaagtaactaaaccgaacggcccggtacctacggaacgggacctccgtacggacgtacgttactcttcgaaccgtcctaaccgaacgtacggaacggaaccacgacgactactacacgaacctacgacgaccggacccgggacgtaggtaccgtaagggagagggacggtcgtaaacttacgttacgttaacgtcgtacggacgggtacggacggaacgacgacgttacggtaccttaaaccgttggggtttccgggtttgggttaccggggtacgggaaacggtaacccgcggttaccgttacggttcccgttaaggttccgtaaccgaccggtaccggaccggttccgttccccgttcccccggg

SEQ ID NO: 346774 - DNA, 606 bp, Homo sapiens
  misc_feature: GZ8MTXP01C7TL5.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagacggccaggccacgtcccctgtactggtcatctatacaaagataaacaagccgcctcgagggctcccgtgagcgtattcctcgtcggcctccctaaacgtcgtacgggaaaccaccacgaccctacttcacgacccagcgacggaccgggaacccagggctaacgggatggacggtcctaggtaaccttagtttaacgcgtaccggaggtccggtagggacacggcacgtcctaaccgtagttgggttcgggtttcggggacgggaacgggtaacccaaggttccgttcggacccggttcgtacgggtccaaccggcccgaacgggtcccttcccggtccccccgg

SEQ ID NO: 346775 - DNA, 643 bp, Homo sapiens
  misc_feature: GZ8MTXP01APTX4.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataatatgcttgctggtatcagcagaggccaggccacgtcccctgtactggtacatctatacaagataacgaacgccggaccctacgagggactccgtacgacgcgtattcctcgtacggcctcccgaactcgtagggaacctacgacgacctactctacgacccatccgacgggacccgggaaccccgaggtaccgtaaccgggagttacgggacggtcgtacgtaacgttaagttaccgtgtacggagggtccggtagggacgacggtacacgggtacctaccgttaggttgggttcgggggttttccggggacgggaacggggaaccgtaacggccgttcggttacccggttccgttagggtccgaaccggtcccgaacgggttcccgttcccggttccccccgg

SEQ ID NO: 346776 - DNA, 733 bp, Homo sapiens
  misc_feature: GZ8MTXP01CTWQW.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatacaagataacaagccggccctacgacggggactccccgtagacgacgtattctcgtcggcctccaaacgtcgtacgggaaccaccgacgacccaactcctacgaaccctaagtccgaacgggacccggggaacccgaacggggtaccgtaaccggggattacgggaacgggtacgttacggtaaactttaacgtttaaccgttggttaccggaaggggttaccgggtacgggggtaaacaccgggaccgaaaccgggtaccctaaacccggtttaaggttcggggttttcgggggtttttacccggggaaccgggggttacggggtaaaaccccgtaacgggttcccggttcgggttaaccccggtttcccggttacgggggttcccaacccggggttaccccgaacggggtccccgtttccccggggttccccccccgg

SEQ ID NO: 346777 - DNA, 572 bp, Homo sapiens
  misc_feature: GZ8MTXP01DCELZ.8.12.B01.1.454.CMB.2.raw
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcgcctnaggactcccgtgagcgattctacgtcggcctcccaaacgtcgtacgggaacacgacgccacgtctagaccatcgacgccgggacccaggctaacgggatggagctagacttagttacgngttaccgaggtcgtggggacaacggcaggtccaaccgttagttcggttaacggttttcgggacgggttaacgggaccgaaggttccgttgaccccgttcgtacgggtcacggtcccgaacgggtcccttccggaaccccccg

SEQ ID NO: 346778 - DNA, 518 bp, Homo sapiens
  misc_feature: GZ8MTXP01AY3VA.8.12.B01.1.454.CMB.2.raw
  modified_base (314)..(314): a, c, t, g, unknown or other
  misc_feature (314)..(314): n is a, c, g, or t
  modified_base (421)..(421): a, c, t, g, unknown or other
  misc_feature (421)..(421): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgcctcaggntcctgagcgatctctggctccaaactcgtacgggaacacagccactctgaccatcacgcgggacccaggcgtacggatgaggctagactattacgtgtcgaggtcgngggacgagcatacacctagtggttgggttttcgggcggttacgggaccgaaggcgttcgaccgtccgtggtcacgccgacggtccgttcgtcccccg

SEQ ID NO: 346779 - DNA, 511 bp, Homo sapiens
  misc_feature: GZ8MTXP01BFCM5.8.12.B01.1.454.CMB.2.raw
  modified_base (457)..(457): a, c, t, g, unknown or other
  misc_feature (457)..(457): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgcctcagggatccctgaagcgattctctcggctccaactctagggaacacacgcactctagaccatcagccgggaacccagggactacgggatgacggctagtactattacgtgtacgaggcgtggacagcagacctagtggtggtttcggngggacggacaagcgttgccgttcgtggtcaacgcccgaggcctccgccccgtcg

SEQ ID NO: 346780 - DNA, 509 bp, Homo sapiens
  misc_feature: GZ8MTXP01AXQQA.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatacaacataacaagcgccctcgaggactccgtgagcgtattctcgtcggctccaactcgtacgggaacacacgccactctgaccatcagcggaccaggctacggatgaggctagactagttacgtgtcgaggcgtgggacagctagtcactagtggtggtttcggcggaggaccagcgttcgaccgtcgtggtcgcgccgaggtccgttcgtccccg

SEQ ID NO: 346781 - DNA, 548 bp, Homo sapiens
  misc_feature: GZ8MTXP01EYG9S.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggccctcgaggggactcccgtgacgcgtattctctggcctccaaactctcgggaacacacgccactctcgaccatcacggcgggacccgaggctacgggatgaggctaggacttagttaaccgtgtcgaggcggtcgggacacgcagcaccttagtggttcggttttcggggcggttacgggaccgtaagcgttcgcccgttccgtcggtccgacggcccgacggtccgttccgtcccccgg

SEQ ID NO: 346782 - DNA, 540 bp, Homo sapiens
  misc_feature: GZ8MTXP01AS7AA.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcattgtccgtgtccccaggacagacagccaggatcacctgctctggagataaagttgggggataaatatgcttgctggtatcagcagagccaggccaggtcccctgtactggtcatctatcaagataacaagccggccctacgagggactcccgtgagcgattctcgtggcctcaactctagggaacacagccactctgaccatcgagcgggacccaggctacggacgtgaggactggactattaacgtgtcgtaggcggtgggacacgcagcaccgtagttcggtggttttcgggcggttacgggaccgaacggcgttcggacccggttccgtggtccgacgcccgaacggtccgccggtcccccgg

SEQ ID NO: 346783 - DNA, 709 bp, Homo sapiens
  misc_feature: GZ8MTXP01ENQ5X.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccaggatcacctgctctggagataaagttgggggaataaatatgcttgctggtatcagcagacggccaggccacgtcccctgtactggtcatctatacaagataacagccgcctcgacgggctcccgtgacgcgtattccgtctacgggcctccaacgtcgtacgggaaacacacgcctactctagaccatacgacggacccgggaaccagggacgtacgggattacgggaacggtcgtacggtaacgtttaactttaacggtacggttccggaaaggggtcccggttagggggaaccgaacgggtaccgaacggtaccgttaaaccccgtttagggttcggggtttttcgggggttttacccgggggaccgggggttaaacggggtaaaccccgaaacggggttcccgttaccggggttaacccccgggtttcccgttttcggggtaacccctaacggggacccccggttaaacgggtcccccgttccggggttcccccccccggg

SEQ ID NO: 346784 - DNA, 544 bp, Homo sapiens
  misc_feature: GZ8MTXP01AJOO3.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagccggaccctcgagggactcccctgagcgattcctctacggcctccaaactccgtagggaacacacgccactctacgaccagtccgaacggccgggaacccgaggccgtaacggagtcgagctggactattacgtgtacgaggcggtggacagcagcaccgtgtggtcgggtttcggcgggttagggacctaaggccgttcggaccgtcgtggtcacgtcccgaggtccttccgtcccccg

SEQ ID NO: 346785 - DNA, 599 bp, Homo sapiens
  misc_feature: GZ8MTXP01DKBG6.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatacaagataacaagccggccctacgacggggactcccgtgacgtcgtacttctcgtcggcctcccaaactcgtacgggaaacaccacgccactctgaccagtcgacggaccgggacccagggacgtacggataggagctagaacttattacgtgtacgagggtcgtggggacacgcacgacaccgtaggttcgggtttgggttttcggggacgggacgggtaaccgaaggttccgttccgggttacccggttccgttcgggtaaccgaccggaccccgttaacggtcccgttcccggtccccccgg

SEQ ID NO: 346786 - DNA, 571 bp, Homo sapiens
  misc_feature: GZ8MTXP01A89IP.8.12.B01.1.454.CMB.2.raw
  modified_base (392)..(392): a, c, t, g, unknown or other
  misc_feature (392)..(392): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctcgtggagataaagttgggggaataaatatgcttgctggtatcagcagaggccgaggccacgtcccctgtacgtggtcatctatacaagataacaacgcggccctacgaggactccgtgacgcgtatcctcgtacggcctccaacgtcgtagggaaccacgacgccactctagacctancgagccgggaccaggcaggacgtgacgtctagtactacgttagcgtacgacggtcggtaggacacggctacgctaacgttagtcgggttcgggtttaccgggcggttacggacgaacggttcgttcgttacccggtcgttacggcgtaacgccgttaacggtccgttcccgtcccccgg

SEQ ID NO: 346787 - DNA, 725 bp, Homo sapiens
  misc_feature: GZ8MTXP01D533S.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatacaagataacaagcgccctcgagggactcccgtgagcgattctcgtcggcctccgaactcgtacgggaacacagccactctacgaccagtcgacggaccgggaaccccgagggaccgtaacgggagttacggaacgggtacctacggtaacctttaacgtttaacccgttaggttaccggaacgggggtccggggttacgggggaaccgaaacgggtccgtaaacggggaccccttaaacccggtttaacgggtttaagggggtttttcgggggttttttacccgggggaccggggggttaaaccgggggaaaccccggtaacgggttacccggttccggttaaccccggggtttccccggtttacggggttaacccggaaccgggacccccggttaaaacggggtccccgttcccgggtcccccccccggg

SEQ ID NO: 346788 - DNA, 649 bp, Homo sapiens
  misc_feature: GZ8MTXP01B0CWT.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccaggatcacctgctcgtaggagaagttaaaggttagggggaataaatatgtcgttgcgtggtatcgagacgaggacggaccgacggcccacgtcccctgtacgtcggtactatactatacaaagaactaaacgaacggccggaccctacgaacgggactcccgtagacgacgtacttccgtcgtcgggtacctccaacgttaccggacgggaaaccacgaccgaccctaacttccacgaacccagtccgacgggacccgggtacccgaggacgtacggataggacggtctagtaactattacgtgacgaggtcggagacacggcacggactaacgttggtcgggtttacgggttccgggacgggaacggaacgtacggttccgttcggttacccgttccggttggaaccgaccggacccgttacgtcccgttcccgttcccccgg

SEQ ID NO: 346789 - DNA, 647 bp, Homo sapiens
  misc_feature: GZ8MTXP01CNLC8.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggaataaatatgcttgctggtatcagcagaggccaggccacgtcccctgtactggtcatctatacaaagataaacgaaacggccggaccctacgacggggtactcccgtaggacgcgtattcctccgtcgggtcctcccgaaacctccgtacggggaacacgacgccaactcgtacgaaccactccgacggcccgggaacccgacgggccgtaacggagttcgggacggtctacggtaacgttagtttacgtgtaccgagggtccggtaggacgacgacgacgtacccgtacgttacggttgggttcggggttttaccggggacgggacgggtaacccgaagggttcccgttcgggaccccgtttcggtcgggtccgtacggaccccgttaacggtcccgttcccggttcccccgg

SEQ ID NO: 346790 - DNA, 690 bp, Homo sapiens
  misc_feature: GZ8MTXP01ER0V9.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctggagaataaagttggggaataaatatgcttgctggtatcagcaggacggccaggccacgtcccctgtactgtcatctatacaagataacaagccgccctagacggctccgtagacgcgtattcctcgtacggcctcccgaaacgtcggtacgggaaccacgacgaccactcgtacaaccacgtacgaccggacccgggaacccgacgggtacgtaacgggagtacgggaacggtcttacggtaacctttagtttaaccggtcggttaccggaggggtccggtacggggaacaacgggccaaacgggtcctaacccggtttaaggtttcgggggttttcgggttttaccgggggaccgggttaacggggtaacccgtaacgggttccgttaccgggttacccggtttccggtttacgggtaacccgaaccggaccccggaacgggttccccgttccccggttcccccccggg

SEQ ID NO: 346791 - DNA, 514 bp, Homo sapiens
  misc_feature: GZ8MTXP01BEMLI.8.12.B01.1.454.CMB.2.raw
  modified_base (346)..(346): a, c, t, g, unknown or other
  misc_feature (346)..(346): n is a, c, g, or t
  modified_base (376)..(377): a, c, t, g, unknown or other
  misc_feature (376)..(377): n is a, c, g, or t
  modified_base (402)..(402): a, c, t, g, unknown or other
  misc_feature (402)..(402): n is a, c, g, or t
  modified_base (432)..(432): a, c, t, g, unknown or other
  misc_feature (432)..(432): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatcaagataacaagcggaccctcgaggactccctgagcgactcgtacgacggcncaactcgtagggacacagccactctgaccnncgaggccgggaccctagcgacggangagcgtgtacgtactagtgtacgacggcgnggacgacgcgtcgactacgtgtggttcggttcggtcggacggacgacgcgttcgcgtcgtcgtcgcgcgacgtcgccgtccg

SEQ ID NO: 346792 - DNA, 680 bp, Homo sapiens
  misc_feature: GZ8MTXP01A6AYY.8.12.B01.1.454.CMB.2.raw
  modified_base (310)..(310): a, c, t, g, unknown or other
  misc_feature (310)..(310): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacagcgcctnagggactccctgagcgattctactggcctccaactcgtagggaacacagaccactcctacgaccacgtcgaacggaccgggaaccccgaggtaccgtaaccgggagttcggaacggacgttacggtaacttaacgtttaacgttcggttacccggaaagggtcccgggttaggggaaccgtaacggaccgtaacggacccgtaacccgttaaggttcggggttttcggggtttttaccgggggacggggttaaacggggaacccgtaaacgggttcccggttcgggttaaccccggtttcccggttttacgggtaacccgaaccgggtaccccggttaaacgggtcccgttcccgggttccccccccggg

SEQ ID NO: 346793 - DNA, 606 bp, Homo sapiens
  misc_feature: GZ8MTXP01AKR0S.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatcaagataacaagccgcctcgagggactcccgtgacgcgtattcctcgtcggcctccaactcgtacgggaacacacgccactctagaccatcgacggaccgggacccagggctaacgggattcggaaggcttacgacttagttacgtgttccgaaggccggtagggacgacgcgtaacgtaaaccgttagttcgggttcgggttttccggggacgggggtaacgggaccgaaaggtccgttacgggttacccgttccgtttcgggacgtaaccggccccgtaagggccttaaccccgggccccgtttcccggg

SEQ ID NO: 346794 - DNA, 532 bp, Homo sapiens
  misc_feature: GZ8MTXP01EONF1.8.12.B01.1.454.CMB.2.raw
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggcctcgagggatcccgtgagcgattctcctggcctccaactcgtagggaacacacgcccactctagaccancgagccgggaacccgaggaccgtacgggatggaggntacgactagttacgtgtcgagggccgtgggacacgctaagctaccgtagtggttaggtttcgggcgggttacggacgaagcgttgttaccgtcgtggtcacgccacgccgttcgtccccg

SEQ ID NO: 346795 - DNA, 708 bp, Homo sapiens
  misc_feature: GZ8MTXP01CMHP6.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcattgtccgtcgtccccaggacagacagccaggatcacctgctctggagaataaagtgggggaataaatatgcttgctggtatcagcagacggcaggccacgtcccctgtactggtcatctatacaagataacaagccgccctagagggactcccgtagacgtcgtacttcctcgtcggtacccttcccgaaacgtttcgaacggggaaaccacgaaccgttacccaaccttaccgtacggaaccctaacgtacggaaccgggaccccgggaacccggtacgggaccgttaaccggggattacgggaacgggtaccgtacgggttaaacttaacgttttaacccgtgggttaaccggaacgggttccgggtacgggggacaacggtccgaaacgtcccgtaaaccgtttggttcggggtttacgggttttaccggggacggggttaacgggtaacccgaacggttccgttcggttacccggttccgtacgggttccgaccgggacccgacggtcccgttcccggttccccccgg

SEQ ID NO: 346796 - DNA, 594 bp, Homo sapiens
  misc_feature: GZ8MTXP01ESGZ0.8.12.B01.1.454.CMB.2.raw
  modified_base (412)..(412): a, c, t, g, unknown or other
  misc_feature (412)..(412): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtcgtcccaggacagacagccaggatcacctgctctggagataaagttgggggaataaatatgcttgctggtatcagcagacggccaggccacgtcccctgtacgtggtcatctatacaagaactaaacgaacgccggaccctgacggggactcccgtgacgcgtactttcctcgtacggacctcccgtaaacgtcgtacgggaaaccacgacgccctactctacgaaccancgaacggaccgggacccacgggtacgtacggagtcgaggtactagtaacttagttacgtcgtacgacgggcgtggacagcagcctacgttagtggttcggtttcgggacgggttacggacgtaacgcgttcggttaccgttccgttcggtcgaaccgccgacggtccgttcccggtcccccg

SEQ ID NO: 346797 - DNA, 487 bp, Homo sapiens
  misc_feature: GZ8MTXP01C5FSB.8.12.B01.1.454.CMB.2.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (390)..(390): a, c, t, g, unknown or other
  misc_feature (390)..(390): n is a, c, g, or t
  modified_base (441)..(441): a, c, t, g, unknown or other
  misc_feature (441)..(441): n is a, c, g, or t
  modified_base (479)..(479): a, c, t, g, unknown or other
  misc_feature (479)..(479): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcgcctcagggntcctgancgattctctcggctcgaactcgtagggaacacagcactctgacagtcagcgggacccaggctacggntgagctgactattatgtcaggcgtggacagcagcactagtgtggtttcggnggttaggacaagcgttcgacgtcgtgtcagccaggtcncgtccccg

SEQ ID NO: 346798 - DNA, 561 bp, Homo sapiens
  misc_feature: GZ8MTXP01DK249.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgcccgtgtccccaggacagacagccaggatcacctgctctggagataaagttggggataaatatgcttgctggtatcagcagaggccaggccacgtcccctgtactggtcatctatcaagataacaagccggccctacgagggactcccgtgagcgtattctctcggctccaactcgtagggaacacgacgccactctgaccatcacgcggacccagcacgagtgagctgactattacgtcgtcgaggcgtgggacgagcagcctacctagtggttcgggttttcgggacgggttacgggaaccgaagttccgttcggttacccggttccgttacgggtccgaccggaccccggttaacgggtcccgttcccggtcccccccgg

SEQ ID NO: 346799 - DNA, 521 bp, Homo sapiens
  misc_feature: GZ8MTXP01CJ6U1.8.12.B01.1.454.CMB.2.raw
  modified_base (502)..(502): a, c, t, g, unknown or other
  misc_feature (502)..(502): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagccggccctcgagggactcccgtgacgcgtattctcgtcgggcctcccgaactcgtacgggaacacacgccactctcgaccatcgacgccgggaccaggctacggatgaggctggactattacgtgtacgaggcgtcgggacagctatcactagtggttgggtttcggcgggaggacagcgttcgaccgtcgtggtcncgccgagtccgcgtccccg

SEQ ID NO: 346800 - DNA, 569 bp, Homo sapiens
  misc_feature: GZ8MTXP01AWZC4.8.12.B01.1.454.CMB.2.raw
  modified_base (418)..(418): a, c, t, g, unknown or other
  misc_feature (418)..(418): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagccggacctcgagggactcccgtagacgcgtattcctcgtcgggcctccaactcgtacgggaacacacgccactctgaccatcgacggccgggtaacccagggcctacgggacnggacggctaggaccttagttacttggtacgagggcgtggggacaggcagcaaccgttgtcggttgggtttccgggaggttacgggaaaccacggttcgttcggttaccggttccgtcggtccacggcccgaacggtccgttccgtcccccg

SEQ ID NO: 346801 - DNA, 712 bp, Homo sapiens
  misc_feature: GZ8MTXP01C4XI7.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagagtaaagtgggggaataaatatgctgctggtatcagcagacggccaggccacgtccctgtacgtgtcatctatacaaagaataaacgaacggccggaccctacgacggggtactccccgtagacggtcgtactttccgtccgtacgggtacccttcccgtaaacgtcccggtaaggggaaaaccaccgaccggtaccctacccgtactaccggaaccctacgaccgaccgggacccggggaaccccgacggggtaccgtaacgggacgttacgggaacggtaccgtaacggttaacctttaacgtttaacggtaccgttacgggacgggtacccggttaagggaccgacggacgaacgtaccgtaaccgttaggttaacgggtttcgggggtttaccgggacgggttaaaccgggtacgtaacggttcgttcggttacccggttcgtacggtaaccgaccggacccgttacggtccgttcccggtcccccg

SEQ ID NO: 346802 - DNA, 681 bp, Homo sapiens
  misc_feature: GZ8MTXP01AUP56.8.12.B01.1.454.CMB.2.raw
  modified_base (341)..(341): a, c, t, g, unknown or other
  misc_feature (341)..(341): n is a, c, g, or t
  modified_base (400)..(400): a, c, t, g, unknown or other
  misc_feature (400)..(400): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttagctggtatcagcagagccaggccacgttcccctgtactggtcatctatacaagataacgaacggcggccctacgacgggtactcccgtgacgngtacttctcgtacggcctcctaactcgtacgggaaccacacgaccactctagaccccanccgacggccgggaacccgagggacgtaacggagttacggaaggccgttagaccgtttaaacgttcgtacgttaccgaggggtccggttggggaacccaagggttcaacgggacccttaaaccgttggttccggggttttaagggggttttcccggggacggggttaacgggaaccggtaaacgggccgttacggggttaccccgtttcccgggtttacgggtaacccgtaaccgggtaccccggaaaccggggtccctttaaccccggggttcccccccgg

SEQ ID NO: 346803 - DNA, 581 bp, Homo sapiens
  misc_feature: GZ8MTXP01EYY03.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcacctgctctaggagataaagttgggggataaatatgcttgctggtatcagcagaggccaggccacgtcccctgtactggtcatctatacaaagataacgaacgccggaccctacgacggggactcccgtagacgcgtacttctcgtcgggcctccaaacgtcgacgggaaccacgacgccactctagaccatcgacggccgggacccaggtctacgggatgacgtctaggtacttattacgtggtacgagggcggtacggacacgcgacgtcctaccgttaggtgggtttcgggtttacgggacgggttacggacgaagttcgttcggaccgttcggtgtaaccgacggaccgagtcccgttccggtccccg

SEQ ID NO: 346804 - DNA, 657 bp, Homo sapiens
  misc_feature: GZ8MTXP01EPKR3.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagataaagttgggggaataaatatgcttgctggtatcgagcaggaggccaggccacgtcccctgtactggtcatctatacaagataacgaagccggaccctcgagggactcccgtgacgtcgtattctcgtcggcctccgaactcgtacggaacacgacgccactctacgaccacgtcgacggaccgggaacccgacgggtacgtaccgggagtacggacggtacgttacggtaacttaacgttacgtggttaccgagggtccggttacggggaacacggaccgaacgggtacctaaccggttaaggttcgggtttacggggttttccggggaacggggttaacgggaaccgtaaacggttccgttcgggttaacccggtttccggttcggtaacgaccgggacccgttaacggtcccgttcccggtaaccccccgg

SEQ ID NO: 346805 - DNA, 645 bp, Homo sapiens
  misc_feature: GZ8MTXP01AOC7A.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataatatgcttgctggtatcagcagacggccaggccacgtccctgtactggtcatctatacaagataaacgaacggccggacctcgacgggactcccgtaggacgtcgtacttccgtccgtacgggtaccctccgtaaaccgtccgttacggggaaaccaaccgacgaccctaaccgtcctacgaaccctagtaccgaacggacccggggaacccgacgggtacgtaaccgggattacgggacggacttaggaactttagttacgtcggtacgaagggtcggtacgggacacggcgacgacgtaccgttggttaacgggttcgggtttacggggacgggttacgggaacgtaacggcgttcggttacccgttcggttggccgacggaccgacggtcccgttcccgtcccccgg

SEQ ID NO: 346806 - DNA, 462 bp, Homo sapiens
  misc_feature: GZ8MTXP01COZXS.8.12.B01.1.454.CMB.2.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(423): a, c, t, g, unknown or other
  misc_feature (422)..(423): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (439)..(440): a, c, t, g, unknown or other
  misc_feature (439)..(440): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaatgggggataaatatgcttgctggtatcagcagaggccaggccagtcccctgtactggtcatctaatcaaagataaacaagcggccctnagggatccctgagcgattcnctggctccaactctgggaacacagccaactctgaccatcagcggacccagggctaggatgagctgactatactgnaggcgngangntnncntgtgttgngngagnngncgctgcncncacgcgcgccg

SEQ ID NO: 346807 - DNA, 573 bp, Homo sapiens
  misc_feature: GZ8MTXP01BPUAE.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctctatgagctgactcagccacctcagtgtccgtgtccccaggacagacagccaggatcacctgctctggagataaagttgggggaataaatatgcttgctggtatcagcagaggccaggccacgtcccctgtactggtcatctatacaagataacgagcggaccctacgacgggactcccgtagacgtcgtattcgtactcgggcctccgaactcgtacgggaacacgacgccactctacgaccatcgaggccggaccgaggctacggatgagctagacttagttacgtcgcgacggtcggtcgggacaggcagtacctaccgtagtcggttcgggtttcggggacggacgggtaaccgtaaggttccgttcggacccgttcgtcggtccgtaacgcccgaaggtccccgttaacggtccccccg

SEQ ID NO: 346808 - DNA, 560 bp, Homo sapiens
  misc_feature: GZ8MTXP01A4HA8.8.12.B01.1.454.CMB.2.raw
  modified_base (395)..(395): a, c, t, g, unknown or other
  misc_feature (395)..(395): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgctgctggtatcagcagaggccaggccacgtcccctgtactggtcatctatcaaagataacaaggccggcctacgaggggactccccgtgaggcgattctctacgggctaacccaaactcgtacggggaaaccacagccaactctagacctancgacggcgggaccccgaggacgtacggagtagacgggctaggacgttattacgtgtcgacggtcggtgggacagacaagtaaccttagtggttgggtttcggcgggacgggttacacggacgttcgccgttcgttggcaacgcccgagcctccgttccccgttcg

SEQ ID NO: 346809 - DNA, 623 bp, Homo sapiens
  misc_feature: GZ8MTXP01CHRJL.8.12.B01.1.454.CMB.2.raw
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcacctgctctggagataaagttgggggaataaatatgcttgctggtatcgagcgagacggccacggccacgtcccctgtactggtcatctatacaagataacgaagcgccctagacgggctccgngacgcgtattctcgtcggcctccaactcgtacgggaacacacgccactctcgaccatcgacggaccgggtaacccagggtaccgtaacgggatcgggacggtactacggtaacttacgtttaacgnggttacgacggggtcgtacggggacacgctacggacctaaccgttaggtcgggtttcgggtttcggggacggggttacgggtaaccgaaggttccgttcgggttacccggttccggttaggtccgaccggacccggttacggtcccgttcccggtccccccggg

SEQ ID NO: 346810 - DNA, 537 bp, Homo sapiens
  misc_feature: GZ8MTXP01D1CLS.8.12.B01.1.454.CMB.2.raw
  modified_base (395)..(395): a, c, t, g, unknown or other
  misc_feature (395)..(395): n is a, c, g, or t
  modified_base (528)..(528): a, c, t, g, unknown or other
  misc_feature (528)..(528): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctctggagataaagttgggggataaatatgcttgctggtatcagcagaggccaggccagtcccctgtactggtcatctatcaagataacaagcgcctcgagggactcccgtgacgcgtattctactcggcctccaactcgtacgggaacacacgccactctgaccatcgaggccgggaacccnggctacggatacgaggtacctggaaccttaagtttaccgtagtaccgagggtccggtagggacagcagccgtacctagtcggttggttcgggcggaggaccaagcgttgaccgtcgtgtcacgtccaggtccncggtccccg

SEQ ID NO: 346811 - DNA, 706 bp, Homo sapiens
  misc_feature: GZ8MTXP01DWX0N.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggactcacctgctctggagaataagttgggggaataatatgcttgctggtatacagcaggacgccacggccacgtcccctgtactggtcatctatacaaagtaactaaacgaacggccggaccctacggaacggggactccccgtaggacgtacgtacttcctaccgtcgggacccttaacccgaaaccttcggtaacggggaaaccacggacctaccctaccgttactacggaaccctacgtaccgaacgggcccgggaacccgtacgggaccgttaaccgggagttacggacggtaccgtacggtaactttaacgtttacccggtggttaacccggaggggtacccggtaggggaacctacggaccgtacggacccttacgttaggttcgggtttcgggttcggggacggttaacggacgtaacgttccggttcggaacccggttcttgggaacccgtaccggaacccgttaggtccccgttaaccccgggtcccccg

SEQ ID NO: 346812 - DNA, 685 bp, Homo sapiens
  misc_feature: GZ8MTXP01ECM9G.8.12.B01.1.454.CMB.2.raw
  modified_base (223)..(223): a, c, t, g, unknown or other
  misc_feature (223)..(223): n is a, c, g, or t
tcagctcgcgtgtccacgaccggtgctcgatttagtagtgtagattccgcggggctggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctagganataaagtggggataatatgctgctggtatcagcagaggccaggccacgtcccctgtactggtcagtctatacaagataacaaggcgacctcgacgggactcccctaggacgtcgattcctcgtcggaccttaacccgaactcgtaacggggaaaccacgacgaccctaactctacgaaccataccgacggccggggaacccacgggtaccgtacggacgtacggagggtactacggtaacctttagtttaccgtacggttacgacggggtaccggttacggggaacgtaacggaccgaacgggtccctaaacccggttaaggttaacgggtttcggggtttttacccgggggacggggttaacgggaacccgtaaacggttccggttcgggttaaccccggtttcggtttacggtccgtaaccggaccccggttaacggtcccgttaacccggttcccccgg

SEQ ID NO: 346813 - DNA, 716 bp, Homo sapiens
  misc_feature: GZ8MTXP01A2S3M.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataaatatgcttgctggtatcagcagaggccaggccacgtcccctgtactggtcagtctatacaagataacaagcggcccctcgaggggactccccgtagacgcgtattcctcgtgggcctcccgtaactccgtaggggaaccacaacgccactacctcgaaccactacgacggacccgggaaccccgacgggacgttaacccggggagttaccggaagggaccgttagggtaaccttaacgtttaacggttacgggttcccggaaacgggggtcccggggttaagggggaaccccgaaggggacccgaaacgggtacccctaaacccgtttaaggttcgggggtttacgggggttttttaccgggggaccggggttacgggggaacccgtaaacgggttccgttccggttacccgggttcccggttttcgggtaaccgacggtacccccggaacgggtcccggttccccgttcccccccggg

SEQ ID NO: 346814 - DNA, 592 bp, Homo sapiens
  misc_feature: GZ8MTXP01EX144.8.12.B01.1.454.CMB.2.raw
  modified_base (401)..(401): a, c, t, g, unknown or other
  misc_feature (401)..(401): n is a, c, g, or t
  modified_base (435)..(435): a, c, t, g, unknown or other
  misc_feature (435)..(435): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccaggatcacctgctctggagataaagttggggaataaatatgctgctggtatcagcagagccaggccacgtcccctgtactggtcatctatacaagataacaagccggcctacgagggactcccgtgacgacgtattcctcgtcggccctaaccgaaacctcgtaacgggaaaccacgacgaccacctcgtcaaccancgacggaccgggaacccagggaccgtaacggagngacgggctaggacttattaacgtcgtacgagggcggaggaacgaggctacggacctaaccgttaggttgggttacgggtttccggggacgggaacgggaacgaacgcgttacgttccgtaacgtcgtcgacgccgacgggtccttaacccgtccccg

SEQ ID NO: 346815 - DNA, 571 bp, Homo sapiens
  misc_feature: GZ8MTXP01B4SRK.8.12.B01.1.454.CMB.2.raw
  modified_base (412)..(412): a, c, t, g, unknown or other
  misc_feature (412)..(412): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccacgtcccctgtactggtcatctatcaagaataacaagccggccctacgaggggactccccgtgacggcgtatttcctcgtgggcctccgaaactcgtagggaacacacgacccactcctgaccatcgaggccgggaacccgnggactaacggagtggaacggtctacgacgtttaacgttacgtcggtacgagggcgtgggaccaggcgtacgctaccgtagtcgggttgggtttcgggcgggacgggtaaccgagacgttcgaccgtcgtggtcacggccgacggtccgttccgtccccg

SEQ ID NO: 346816 - DNA, 784 bp, Homo sapiens
  misc_feature: GZ8MTXP01CFO03.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcaggacgccaggcctacgtcccctgtactggtcactctatacaagataaaccgaagccggtccctacgaacgggtactccccgtaggacggtcgtacttccgtccgtcgggtacccttaacccgaaaccgttacccgttacggggaaacccaaccgtaccggccctaccgtccgttacggaaccctacgtcccgaacgggcccggggaaaccccgtacgggtaaccgtaacgggtagtaccgggtaacggtccgttaacgggtaacctttaagttttaaccggtcgggttaccgggacggggtccggttacgggggaccgtaacgggaccgtaaccggtacgtaaaccccggtttagggttaacggggtttcggggtttttacccgggggacgggggttaaacgggggtaaaccctaacgggttcccggttccgggttaacccccgggtttccggtttacccggggtaacgtccccgggaccccggttaaccggggttcccggttccccggtttccccccccgggg

SEQ ID NO: 346817 - DNA, 717 bp, Homo sapiens
  misc_feature: GZ8MTXP01B3XHA.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagataaagttgggggaataaatatgcttgctggtatcagcagacggccaggccacgtcccctgtactggtcatctatacaagataacgaagccggccctacgagggactcccgtagacgtcgtacttctcgtacggcctcccgaaactcgtacggggaaaccacgacgacccaccttcctacgaaccctaatccgaacgggcccgggaaaccccgagggaccgtaacgggagtacggaacggtctacggtaacttaagtttaaccgtcggtacggtaacgggtccgggttacggggaacctacggaccgtaaacggtaaacccgttaggtttacggggtttcggggtttttaccgggggacgggggtaaacggggttaacccgtaaaacgggtccggttaccgggttaccccggtttccggtttaaccggggtacccgtaacccggaccccggtaacggggttccccgttccccgggttcccccccgtttcccgggg

SEQ ID NO: 346818 - DNA, 625 bp, Homo sapiens
  misc_feature: GZ8MTXP01ACQ44.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccaggatcacctgctctggagataaagtgggggaataaatatgcttgctggtatcagcagaggccaggccagtcccctgtactggtcatctatacaagataacagcggcctacgacggactccctagacgcgtattcctctacggcctcctaaactcgtagggaaccacacgcctaactctacgaccagtacgacggaccgggacccgaggccgtaaccggatacggacggctaggtacttaacgttaacgtggttaccgagggccgtcggggacacgactacggtcctaaccgtttaagttcgggttcggggttttaccgggaccggggaacgggtaacccgtaaacggttccgttacggttaccccggtttccgttacggtccgaccggtacccgaacggtccgttcccggtaaccccccgg

SEQ ID NO: 346819 - DNA, 765 bp, Homo sapiens
  misc_feature: GZ8MTXP01DGVTU.8.12.B01.1.454.CMB.2.raw
  modified_base (295)..(295): a, c, t, g, unknown or other
  misc_feature (295)..(295): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagcaggatcacctgctctggagataagtaggggataaatatgctgctggtatcagcagacgccgaggccacgtccctgtactgtcatctatacaanataacaagccgacctcgacggactcccgtgacgtacgtacgttcctcgtaacgggaccttcccgaaaccgttaccgggttaacggggaaaacccaaccgaaccggaccctaacccttaccgttacggaaccccaaagtcccggaacgggtacccgggggaaaccccgtacggggaccttaaccggggagttacgggaacggtaccgttaacgggtaacctttacgtttaaccggtacggttaacccggtaggggcccgggttaaggggaccgtaaacgggccaaacgggttacccctaacccggtttaagggtttcggggtttttaccgggggttttacccgggggtaaccggggttaacggggaaaacccgtacgggttacccggttcggaaccccgggttttccgtacgggggttaacccaacgggtacccccgaacggggtccccttcccccggttaaccccccggg

SEQ ID NO: 346820 - DNA, 661 bp, Homo sapiens
  misc_feature: GZ8MTXP01A48SX.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggataaatatgcttgctggtatcagcagaggccaggccacgtcccctgtactggtcatctatacaagataacgaagccggccctcgacgggactcccgtgacgcgtattctcgtcgggcctccgaaactcgtacggggaaacaccgacgcccactctacgacctagcgaacggcgggaccccagggaccgtacgggattcggacggtactacggtaaccttaagttaacgtcggtacgtaacggggccggttacggggaaccaacggccgaacgtacccgtaacccgtttaaggttcgggtttacggggtttttccgggggacggggttaccggggtaaccgaacgggttcccgttcgggttaccccggttaaccgttcgggttaaccgaccgggtacccggaacggtcccgttcccggtcccccccggg

SEQ ID NO: 346821 - DNA, 712 bp, Homo sapiens
  misc_feature: GZ8MTXP01CKSGM.8.12.B01.1.454.CMB.2.raw
  modified_base (296)..(296): a, c, t, g, unknown or other
  misc_feature (296)..(296): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggactcacctgctctggagataaagttagggggaataatatgcttgctggtatcagcagaggccagccacgtcccctgtactggtcatctancaagataacgacgccggtccctagacgggtctcccgtgacgtcgtacttctccgttaacggcccttaaccgaaaccgttacggacgggaaaccaccgaacggtaccctacttcccgtacgaaccctacgaccggaacggccccgggaaacccgtagggacgttaaccggggattacgggaacgggtcttacgggtaaaccgttacgtttaacgtcgtaaccggtacggggtcccggtaggggaaccctagggaccacgggtaccctaaccgtttaagggttcggttttaccggggggtttcggaaccgggggaaccgggtaacccgtaacgggttccggttaccggttaccccggttggttaccgggtccgaacccggttaccccggaacggtcccgttaaccccggttcccccgg

SEQ ID NO: 346822 - DNA, 756 bp, Homo sapiens
  misc_feature: GZ8MTXP01B5SJ1.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccacgtcccctgtactggtcatctatcaagataacagcggccctcgagggactcccgtgacgtcgtacttcctcgtcgggccctccaaaccttccgtaggggaaaccaaccgtacggacccctacttaccctacggaaccctacgtcccggaacgggaccccgggggaaccccgaacggggtacccgttaacggggaacgttacggggaacgggtaccgttacgggtaacccgtttaacgtttaaacccggttcggtaccggtaacgggggtacccggggttcgggggaaaccctacggggacccgtaaccgggtacctaacccggtttaaagggtttcgggttttaacgggggtttttcccgggggaccggggttaacggggtaaccccgaagggttcccgttcgggttaacccccggtttccgtttaacgggggtccctaaccggggtaccccggaacggggtccccttcccgggtccccccccggg

SEQ ID NO: 346823 - DNA, 631 bp, Homo sapiens
  misc_feature: GZ8MTXP01A66VR.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagacggccaggccacgtcccctgtactggtcatctatcaagataacaagccgcctgagggactccctgacgcgattctctcggccttccaaactcgtagggaacacacgccactctgacaaactcgacggccgggacccgaggccgtaacgggagtggaacggcgtacggaacgttacttaacgttcgtcgaagggtcggtacggggaccgaacggcctacggacctaaccgttggttcgggtttcggggtttttccggggaccggggttaacgggtaaccccggaaagggttcccgttcggttaaccccggttccggtttcgggtcccgtaccgggaccccggaaacgggtcccgttcccggtcccccccgg

SEQ ID NO: 346824 - DNA, 669 bp, Homo sapiens
  misc_feature: GZ8MTXP01D9XLE.8.12.B01.1.454.CMB.2.raw
  modified_base (466)..(466): a, c, t, g, unknown or other
  misc_feature (466)..(466): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatcacctgctcgtaggagaattaaagtagggggaataaatatgcttgctggtatcgagcgagacggccaggcctacgtccctgtactggtcatctatacaaagataaacgaacgccggaccctacgacgggactccgtcgacgacgtattcctcgtaccggtcctaacccgtaacgtacgtacgggaaccacgacgacccactctacgaaccactacggacggacccgggaacccgtacgggtaccgtaaccgggtanacgggaacggtacgttacggtaactttaacgtttaacggtcggtacggacggggtacggacggggacgagacgtacgtaccgtaaccgtttaggttcgggtttacgggtttacggggacgggttaacggaaccgtaacggttccgttcggttacccgttcgttcgaaccgaccggaccgacggtccccgttccgtaacccccg

SEQ ID NO: 346825 - DNA, 515 bp, Homo sapiens
  misc_feature: GZ8MTXP01EXNPI.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcggcctcagggactcccgtgagcgattctctggcctccaactctagggaacacacgccactctgaccatcgagccgggaccaggctacggatgaggctgactattactgtcgaggcgtgggacagcagcgacctagtggttggttttcgggcgggttagggacaaggcgttcgaccgttctcgtcgacgccgaacgtccgttcgtccccg

SEQ ID NO: 346826 - DNA, 784 bp, Homo sapiens
  misc_feature: GZ8MTXP01APIH4.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggactcacctgctcgtggagaagtaaaggttagggggtaataaagtatgtcgttgcgtggtatcgagcgaggacggaccgacggcccgtaccgtccccctagtacgtggtacatactatacaaagaacgtaacgaacggccggacccgtacgacgggtactcccgtagacggtcgtacttccgtcgtacggtaccctccgtaaacgttcggaacgggaaaccaccgaccgtaccctaacccttccgtaccgaaccctaacgaccgaccgggacccgggaacccgacgggtaccgtaacgggattacgggaacggtctaacgtacgtttaacgttaacggttcgtaccgggtagggtccgggttaacgggaaccgtacggaccgtaaccggtacccgttaacggtttaacgggtttcggggtttacccgggggttttacggggaacccgggggttaaaccggggaacccgtaaacgggttcccggttacccgggttaccccgggtttccggtttaaacggggtcccgaacccggtaccccgggttaaccgggtccccggtttcccccgggttcccccccggg

SEQ ID NO: 346827 - DNA, 522 bp, Homo sapiens
  misc_feature: GZ8MTXP01DWIFO.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgcttgctggtatcagcagaggccaggccagtcccctgtactggtcatctatcaagataacaagcgcctcaggactcccgtgagcgattctcgtacggctccaactcgtacgggaacacagccactctcgaccagtcacggcggacccaggctacggatgaggctagacttattacgtgtacgaggcgtggacagcagcactgtggttcggtttcggcggttacggacgaagcgttcgaccgtccgttggctacggcccgacggtccgttccggtcccccg

SEQ ID NO: 346828 - DNA, 641 bp, Homo sapiens
  misc_feature: GZ8MTXP01BQDGD.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctcgtggagagtaaagttagggggataaatatgcttgcgtggtatcagcaggacggccacggccacgtccctgtactggtcatctatacaagataacgaagccgcctacgacggctccgtcgagcgtacttctcgtcgcctccgaactcgtacgggaacacgacgccactcacgaccagtcgacggacccgggaccgagggacttaacgggattcgggacgacttacggtaacttacgtttacgtggttaccgagggtccggagggacacgcgtaacgtccctaaccgtttggttcgggtttcggggtttacccggggacggggttaacggtaaacccgacggttcccggttacggttaccccggtttcggttcgggtaaccaccgggacccgttaacgggtccccttaacccgggttccccccgg

SEQ ID NO: 346829 - DNA, 650 bp, Homo sapiens
  misc_feature: GZ8MTXP01B00U7.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatcacctgctctaggagaagtaaagtgggggtaataaatatgcttgctggtatcagcagagccaggccacgtccctgtactgtcatctatacaagataacaacgccgcctacgaggtactcccgtggacgtgtacttcctcgtcggacccttccgaaacgttccgaacgggaacaccgacgacctactctacgaaccaagtcgaccggaccgggaaccccgaggggtacccttaacgggaagttcggaacggtacgttacggtaaaccttagtttaacggtcgtaccgggaaggggttccggaggggaacacggacgcgtaccgtaccggttagttcgggtttacgggtttacggggacgggttaacgggaaccgtaacgttcgttaccgccggttccgttaggaaccgcggaacccgacgggtcccgttcccggtcccccg

SEQ ID NO: 346830 - DNA, 608 bp, Homo sapiens
  misc_feature: GZ8MTXP01CQ8ZH.8.12.B01.1.454.CMB.2.raw
  modified_base (298)..(298): a, c, t, g, unknown or other
  misc_feature (298)..(298): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagcaggatcacctgctctggagaagtaaagtaggggaataaatatgcttgctggtatcagcaggacggccaggccacgtccctgtactggtcatctanacaagataaacgaacggccggcctacgacggtactcccgtagacggtacgtattcctcgtacggcctaaccgaaactcgtaacgggaaaccacgacgcctactctacgacctacacgaccggaccgggacccgaggaccgtacggagtagagtctagtacgttattacgtgacgagggtcgtaggacaaggcaagtacctaccgttaggttcggttcgggtttcggggacgggacggaaccgtaaggttccgttcggttacccgttcgtcggtccgacggcccgttacgggtcccgttcccggtcccccg

SEQ ID NO: 346831 - DNA, 692 bp, Homo sapiens
  misc_feature: GZ8MTXP01EQGN0.8.12.B01.1.454.CMB.2.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (301)..(301): a, c, t, g, unknown or other
  misc_feature (301)..(301): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggactcacctgctcgtaggagtaagtaaagttgggggaataaatatgcttgctggtacncagnagcgcacgccacgtcctgtacgtgtacatactanaagaagtaactaacgaacggccgaccgtacgacggtactccgtagacgtacgtacttccgtcgtaccggtaccctaaccgtaacgtacggtaacggaaccacgacgacctactacgacgacacgtaccggacgggacccgggtaaccgacgggtacgtacggagtacggaggtacgttaacgtaacgtttaacggttacgtacggtacgggtacgggtacggtacggaacgtacgcgtaccggtacttaacggttcgggtttcggggtttacggggtttaccggggaacggggttaaccggtaacggtacggttaccggttccgggttacccggttccggtacgggtaaccgaaccggtacccgggttaccggtcccgttcccggtccccg

SEQ ID NO: 346832 - DNA, 538 bp, Homo sapiens
  misc_feature: GZ8MTXP01D3GUA.8.12.B01.1.454.CMB.2.raw
tcagctcgcgtgtccacgaccggtgctcgatttagtagtgtagattccgcggggctgggcctcaggaagcagcatcggaggtgcctcatccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccaggccagtcccctgtactggtcatctatacaagataacaagccggccctcgagggactcccgtgacgcgtattctcgtcggcctccaaactcgtagggaaccacgacgccactctacgaccatcgaggaccgggacccaggctacgggatggagctagacttacttacgtgtcgagggcgtgggacagcagcacctagtggttggtttcgggcggttaggaccgaagcgttcgaccgtcgttggcacggcccgaggtccgttccgtcccccg

SEQ ID NO: 346833 - DNA, 653 bp, Homo sapiens
  misc_feature: GZ8MTXP01A0E2H.8.12.B01.1.454.CMB.2.raw
  modified_base (368)..(368): a, c, t, g, unknown or other
  misc_feature (368)..(368): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtgcctcctatgagctgactcacgcccaccctcagtcgtccgtcgtccccaggacagacagccgaggactcacctgctcgtaggagtaattaaaggtggggaataaatatgtacttgtcgtggtatcagacgaggacgccgacggccacgtcccttgtacgtggtcatctatacaagaataacaacggccggaccctacgacgggacctccgtagacgcgtattcncgtacgccttccactcgacgggacacacgcctaactcccgtagaccagaccgacgggacccggaccccgagggtcaaccgggtagacggtaacggtacttacggttaacttacgtttacgcggtacggtacggggtacggtcggggaacacgacgtaacgtaccgtaacttgggtaacggtttcggggttaccgggggacggttacggaaccgtacgaccggttccgttaccgttaacggtcgaaccgaccgtaccggacggttcccgccccggggttaaccccg

SEQ ID NO: 346834 - DNA, 532 bp, Homo sapiens
  misc_feature: GZ8MTXP01AKL79.8.12.B01.1.454.CMB.2.raw
  modified_base (523)..(523): a, c, t, g, unknown or other
  misc_feature (523)..(523): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatacaagataacgaagcggccctcagggatccctgagcgattctctggcctccaactcgtgggaacacgacgccactctgaccatcgacggcgggacccaggactacgggatggacggctgacttattacgtgtcgagggcggtgggacaggcagccactagtggttcgggtttcgggcgggttacgggaccaagccgttcgaccggttcctggtccacgcccgaaggtcccncgtcccccg

SEQ ID NO: 346835 - DNA, 561 bp, Homo sapiens
  misc_feature: GZ8MTXP01BVQX7.8.12.B01.1.454.CMB.2.raw
  modified_base (550)..(550): a, c, t, g, unknown or other
  misc_feature (550)..(550): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccaggccacgtcccctgtactggtcatctatacaagataacgaacgccggaccctcgagggactcccgtgacgcgtattctcgtcggctccactcgtagggaacacgacgccactctacgaccatcgacggacgggaccccagggtacctacgggatgaaggtctaggtacttacgttacgtgtacgagggtcggtgggacagcgtacgctaccgtgtggttcgggtttcgggcggttagggaccaagttcgttcggacccgttcgtggtcacggccgaggtcccnccggtcccccg

SEQ ID NO: 346836 - DNA, 609 bp, Homo sapiens
  misc_feature: GZ8MTXP01A1NTB.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcgtggagataaagttggggataaatatgcttgctggtatcgagcagacggccaggccacgtcccctgtactggtcatctatacaagataacagccgacctcgacgggctccgtagacgcgtattctctcgcctccaacgtcgacgggaacacgacgcacgtctacgaccagacgacgggccggaacccgagggtaccgtacgggaagttcggacggtccgtaacggtaccttaagttaccgtggtacccggagggttccggtaggacgagccgacggtcctaaccgtgttaacggttcgggttttacgggacgggttaacgggaaccaacggttcgttccgttacccggtccgtttcggccgacgtacccgaccgtccgttcccggtccccccg

SEQ ID NO: 346837 - DNA, 847 bp, Homo sapiens
  misc_feature: GZ8MTXP01B4T62.8.12.B01.1.454.CMB.2.raw
  modified_base (526)..(526): a, c, t, g, unknown or other
  misc_feature (526)..(526): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcgagtcgtccgtcgtccccgaggacagacagcaggactcactgctcgtaggaagtaagttaaaggtggggaataatagtgtacttgtcgtaggtatcgagacgaggacggaccgacggccgtaccgttccccgtaggtacgtcggtacactactaactaacgaaagtaacgtaaacgaacggccggtaccccgtaggaacgggtaccttacccggtaggtaacgtcgttaacgtttccgtcggtacggtacccttaaccgtaaacccgttacgggtaacgggaaaccaccgaaccggtaccctactttaccgaccgaaccgtaccgacggacccgggacccgggaacccgngggtacccgtaacggagtacggacggtaccgttaacgtaacgtttaacgtttacccgggttaggaccggggtaacggggttccgggggtaaccggaacggtaacccggacgtaaccgggttacccgtaaacccgggtttaaggggtttccgggggttttaccggggggtttccggggaaaacccggggaccgggtaaaccggtaaccgggttccgtttacccgggggttaaccccgttttccggggttaccgggtaaccccgaacccggggttaccccggaaccgggtttccccgttcccccgggtttaacccccccgggg

SEQ ID NO: 346838 - DNA, 553 bp, Homo sapiens
  misc_feature: GZ8MTXP01CRMM1.8.12.B01.1.454.CMB.2.raw
  modified_base (526)..(526): a, c, t, g, unknown or other
  misc_feature (526)..(526): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataatatgcttgctggtatcagcgagacggccaggccacgtcccctgtactggtcatctatacaagataacgagccgacctcgaggctcccgtgacgcgtattcctacgtcgcctccaactcgtacgggaacacgacgccactctagaccatcgacgccggaccaggctacggatgagtctacgtacgttagttaacgtgaccgagggtccggtaggacgacgcacgctaaccgttggtgttcggggttcggacgggcggtaaccgagttccgttcgacccgttcgttcggccncgtacccgacggtccgttccgtccccg

SEQ ID NO: 346839 - DNA, 623 bp, Homo sapiens
  misc_feature: GZ8MTXP01C1UG1.8.12.B01.1.454.CMB.2.raw
  modified_base (213)..(213): a, c, t, g, unknown or other
  misc_feature (213)..(213): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtcccaggacagacagccaggatcactgctntgagataagtggggataaatatgcttgctggtatcagcagagcaggccaggtccctgtactggtcatctatacaagactaacaagcggacctagaggactccgtcgacggctacttctcgttacgggccttaaccaaacgtccgtaaggggaaaccacacggttaccaaactcttacggaacccaacgacgacgggacccggtaaccgaggtacgaacggagtaggacgtactaacgtaacgtttaacgttacgtacggtacggacgggtacgtacgggaacgacgcgtaacgtaccgtaacgttaggttcgggtttacgggttaccgggacgggttaacggaaccgtaacggttcgttcggttacccgttcgtacgaaccgaccgaccgacgtcccgttcccgtccccg

SEQ ID NO: 346840 - DNA, 570 bp, Homo sapiens
  misc_feature: GZ8MTXP01EB23X.8.12.B01.1.454.CMB.2.raw
  modified_base (224)..(224): a, c, t, g, unknown or other
  misc_feature (224)..(224): n is a, c, g, or t
  modified_base (335)..(335): a, c, t, g, unknown or other
  misc_feature (335)..(335): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (524)..(524): a, c, t, g, unknown or other
  misc_feature (524)..(524): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatcacctgctctgganataaagttggggataaatatgcttgctggtatcagcaggacgcacggccacgtcccctgtacgtggtcagtctatacaagaataacgaagccgcctacgagggactcccgngacgcgtacttctctcggcctaaccgtacgtcgtacgggaacacgacgacctaactcagtaccanacgacgacgggaaccccaggtcgaacgganacggagactacgaacttacttacgtcgtacgaggtcgaggacaggtcaagcctaacgtggtgttcgggttggacgggttacgaccgaagttcgnggttacccggtgtacggtcacgtccgaggtccttcccgtaaccccg

SEQ ID NO: 346841 - DNA, 630 bp, Homo sapiens
  misc_feature: GZ8MTXP01DQPHF.8.12.B01.1.454.CMB.2.raw
  modified_base (299)..(299): a, c, t, g, unknown or other
  misc_feature (299)..(299): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagaggccgaggccacgtcccctgtactcggtcatctatanaaagtaataacgaacgccggcctacgacgggtactcccgtagacgtcgtacttcgtcgtacggtcctccgtaaactcggtacgggaaacacgacgaccactactacgaaccacgacgacgggacccgggaaccacgggacgtaacgggatggaggctaggtaaccttagttacgtgtcgagggtcgtagggacacgtacgacgacgtaccgttaggttgggtttcgggggtttccgggacgggttaacgggaacgtaacggttccgttcgggttaccccgtttaacggtggtccgaccggtacccgacggtcccgttcccggtaacccccg

SEQ ID NO: 346842 - DNA, 576 bp, Homo sapiens
  misc_feature: GZ8MTXP01DAUO9.8.12.B01.1.454.CMB.2.raw
  modified_base (342)..(342): a, c, t, g, unknown or other
  misc_feature (342)..(342): n is a, c, g, or t
  modified_base (386)..(386): a, c, t, g, unknown or other
  misc_feature (386)..(386): n is a, c, g, or t
  modified_base (420)..(420): a, c, t, g, unknown or other
  misc_feature (420)..(420): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctggagataaagttgggggataaatatgcttgctggtatcagcaggaggccacggccacgtcccctgtactggtcatctatacaagataacaagccggcctacgacggatcccctgagcgtattcncgtacggcctccaacgtcgtacgggaacacacgaccactcgtanacctatcgacggacccgggaccacggcgtacggntacgagctggacttatacgtgaccgaggccggtagggctaacgcgtaagcctaacgtcttgggttacgggtttcgggacgggacggtaccgagacgttcgttaccccggttcgtcggtccgtacggacccgttacggtcccttcccgggtcccccg

SEQ ID NO: 346843 - DNA, 603 bp, Homo sapiens
  misc_feature: GZ8MTXP01B8190.8.12.B01.1.454.CMB.2.raw
  modified_base (344)..(344): a, c, t, g, unknown or other
  misc_feature (344)..(344): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagataagtggggataatatgcttgctggtatcagcagacggccaggccacgtcccctgtactggtacatctatacaagaataaacagccggcctacgacgggtactcccgtgacgcgactttcncgtagggccctaaccgaaccttcgtacgggaaccacgacggcccaactctacgaccactcgacgccgggacccagggtcgtaacggacgtagacggtactacggacttacgttacgtgtacgaggcggtacggacgagccgaggacctaccgtagtcgggttcgggtttcgggaccgggacggtaaaccgaagttccgttcgttacccgttccgttacgaaccgtcggacccgttaacggtccgttaacccgtccccgg

SEQ ID NO: 346844 - DNA, 773 bp, Homo sapiens
  misc_feature: GZ8MTXP01BHR6M.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggactcacctgctcgtaggaagtaagtaaaggttagggggaattaaagtagtcgtcgttggtcgttaggtactcgagacgaacggacggaccgacggccgtaccggttccccgtaggtaccgtcggtactacttactaactaacaaagtaactaaaccgaacggcccggtacccgtacggaacgggtacctacccgttacggacggtacgtacgtttaccgtccgttacgggtaccctaacccgtaacgttacccgggtaacgggaaaccctaaccgtaacgtacccctaacctaccgtaaccgaacccgtaacgtacccggaaccgggaccccggggtaaaccccggtacggggtaacccgttaacgggaacggtacgggtaacgggttacgttaaccgttaaccgtttaacgtttaccggtacggtacggtacgggtccgggacgggaaccgacggtacgacgtaccgtaccgttaggtcgggttcgggtttcggggacggttacggacgtaacggttccgttcgttaccgtcgtcgtccgacgccgacgtccgttccgtccccg

SEQ ID NO: 346845 - DNA, 589 bp, Homo sapiens
  misc_feature: GZ8MTXP01AYEUG.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataaatatgcttgctggtatcagcagaggccaggccacgtcccctgtactggtcatctaatcaagaataacaagccggccctcgagggactcccgtgagcgtattcctcgttacggccttcccaaacgtccgtacgggaacaccgacgaccaacgtctacgaaccactacgacggccgggaacccgacggacgtaccgggattggaggtactaggacttacgttaacgtgtacgaggcgtcgggacacggcacgacctacgtagttggtcgggttttacgggcgggttacgggaccaggcgttcggttacccgtccgttcggccacggacccgaacgtcccgttcggtaaccccccg

SEQ ID NO: 346846 - DNA, 643 bp, Homo sapiens
  misc_feature: GZ8MTXP01BT2JP.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtgggggaataaatatgcttgctggtatcagcagacggccaggccacgtcccctgtactgtacatctatacaagactaacgaacgccgccctacgagggactcccgtagacgcgtattctcgtcggacctccgaactcgtacgggaaccacgacgacctactctacgaccatcgacggccgggaacccgtaggaccgtacggagtacgggagtcgtacggtaacttagttacgtggtacggagggccggtaggggaactacggactacttaccgtaaccgtttggttcggggtttaacggggttttcgggggaacgggttacggggaaaccgtaacggttccgttccggttacccggtttccggttacggtaaccggacccggtacccggaccggtccgttccccgttccccccggg

SEQ ID NO: 346847 - DNA, 629 bp, Homo sapiens
  misc_feature: GZ8MTXP01EWCEF.8.12.B01.1.454.CMB.2.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (295)..(295): a, c, t, g, unknown or other
  misc_feature (295)..(295): n is a, c, g, or t
  modified_base (441)..(441): a, c, t, g, unknown or other
  misc_feature (441)..(441): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataagtgggataatatgntgcgtggtatcagcagagccgaggccacgtcccctgtactggtcatctatacgaanactaaacgaacgccggaccctacgaacgggactcccgtagacgcgatttcctcgtacgggcctaaccgaactacgtacgggaacaacgacgacctactcgtacaccagtcgacggcccgggaacccagggtaccgtaacgggtagnggacgtacgtacggtaacctttattaacgtgtcgacggtcggtacggggacagccgaacggcctaccgttgtaacgggtttgggtttcgggacgggttacgggaacctaaggccgttacggttaccccggttcgtttacgggtcccgacggaccccgttaacgggtcccgttcccgggtcccccccgg

SEQ ID NO: 346848 - DNA, 626 bp, Homo sapiens
  misc_feature: GZ8MTXP01D6UM9.8.12.B01.1.454.CMB.2.raw
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
  modified_base (499)..(499): a, c, t, g, unknown or other
  misc_feature (499)..(499): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccacctcagtcgtccgtcgtcccagggacagacagccgaggactccacctgctacgtaggaagaagttaaaggttagggggtaattaaagtatgtcgttagcgtaggtatcgagacgaggacggccacggccacgtcccctagtacgtgtacatactaatacgaaagactaacgaacgccggtacctacggacggtactcccgtaggacgtacgtacttctcgtacgacctccaacgtacgtacggaacacgacgtcactnacgacacgcgacgcggaaccagacgtacgntaggacgtatacgtagtaactcgtacgacggaggtaccgngggaacacggctaggtaaccttacggttggttaacggtttcggggttacgggacggttaacgggacctaaggttccgttcggacccgttcggtgaaccgtacgaccgacgtcccgttccggtccccg

SEQ ID NO: 346849 - DNA, 581 bp, Homo sapiens
  misc_feature: GZ8MTXP01DNP9U.8.12.B01.1.454.CMB.2.raw
  modified_base (326)..(326): a, c, t, g, unknown or other
  misc_feature (326)..(326): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcaggatcacctgctctggagaataaagttgggggaataaatatgcttgctggtatcagcagacggccgaggcccagtcccctgtactggtcatctatcaagataacgaagcgccctgaggactccngagagtattctcgtacggcctccgaaactcgtacgggaactacacgaccactccgtagaaccatcgaacggcccgggaacccacggggtacctaacgggactaggaggcgtagtaaccgttatttacgtcgtacgaggtcgtgggactagctacgcctaccgttgtaaggttggtttcggggacggttacggaacctaggccgttcggttacccggttcgtcggtcctacggccacggtcccgttccgtcccccg

SEQ ID NO: 346850 - DNA, 690 bp, Homo sapiens
  misc_feature: GZ8MTXP01BVO34.8.12.B01.1.454.CMB.2.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctaggagtagtaaagttaggggaataaatatgcttgctggtatnagcaggngccacggccacgtcccctgtactggtcagtctatacaagataacaaggccggaccctagacgggtactccccgtaggacgacgtatttcctaccgttcgggacccttaacccaacgttaccggtacggggaaccctaacgaccgtacccctacgtacctacgacccgtacgtaccgacgggcccggggtaaccccgagggtaccgtacgggacgttacggacggtactacgtaacgtttacgttaaccgtcgggttacgacggggtccggtcgggaaccacgggcctacgtaccctacccggttagtttggggtttaccgggttttcgggaccggggttacggacctaacgggttcgttccgggttacccgtttccgtccgggtcacccgggacccgacgggtcccgttccggtcccccccg

SEQ ID NO: 346851 - DNA, 665 bp, Homo sapiens
  misc_feature: GZ8MTXP01DFWPR.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggactcacctgctcgtaggaagtaagtaaagttagggggaattaaatagtgtcttgctggtatcgagacgagacggccgacggccacgtcccctgtactggtacacgtctaatacaaagaataaacgaaacgccggtacccgtacgaacgggtactacccgtagagacgtacttccgtcgtacggtcctaacccgaacgtcgtaacgggaacaccgacgtacccactacgtacgacctacgcgacggaccggacccgacggtacgtaaccgggagtacgacggccttaaggtaacttacttaacgttgtaccggaggggtcggtacgggacgaccgtcgacgtacctaccgttagggttcgggtttcggggtttacgggacggggttaacggaccggtaacgttccgttcggttaccggttccgtacggtccgacgaccgttacgtccgttccgtccccg

SEQ ID NO: 346852 - DNA, 566 bp, Homo sapiens
  misc_feature: GZ8MTXP01D0FL9.8.12.B01.1.454.CMB.2.raw
  modified_base (285)..(285): a, c, t, g, unknown or other
  misc_feature (285)..(285): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccacctcagtgtccgtgtcccaggacagacagccagatcactgctctggagataaagttggggaataatatgctgctggtatcagcaggagccaggccagtcccctgtactggtcatntatacaagataaacagccggaccctgaggactcccngacgcgtattcncgtacgacctcctaactcgacgggaaccacacgcactcgacaccancgacgcgggtaacccagggcacgggangagacgtagtacgtagtacgtagtacgacggnggacggacgacgacgtacgacgtacgtggttgggttcgggttacgggtacgggaacggaacggtaacgttacggttcggttaccggttccgtcggtaaccgacgaccgaccggtccgttcccgtcccg

SEQ ID NO: 346853 - DNA, 740 bp, Homo sapiens
  misc_feature: GZ8MTXP01CT50P.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagataaagttgggggataaatatgcttgctggtatcgaagaagaggccaggccagtcccctgtactggtcatctatacaagataacgaacgccgccctgacggactccgtgacgcgtattctcgtcggacctaccaaccgtcgtacgggaaaccacgacgaccctactctacgaccagtaccgacgggaccgggtaaccccgagggtacccgttaacgggagttcgggaaacgggtccgttaacgggtaaccctttaacggtttacccggttacgggttaccggtaaacgggggtccggggttaacggggaaacccgtaggaacccggaaccggtacctaaccccgtttaagggttcggggttttccgggggttttacccgggggaccgggggtaaacggggttaccccgtaaacggtccggttaaccgggttccccggtttcccggttaacgggtacccgaaccgggtaaccccgtaaccggggttcccgttaaccccgggttccccccgtttcccggg

SEQ ID NO: 346854 - DNA, 703 bp, Homo sapiens
  misc_feature: GZ8MTXP01EUUM6.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatccacctgctcgtggagtaataaaggttggggaattaaatatgcttgctggtatcagcgaggcggaccaggcctacgtcccctgtactcgtcatctatacaaagaactaaaccgaacgaccgggcccctacgacgggtctcccgtaggacgtccggtatttcctccgtacggtaccctaacctaaccgtcgtacgggaaacctaccgacgtccctactcgtacgaaccactacggacggacccgggaacccgacgggaccgtacgggagtcgggtacggtctaccggtacttacgtttacgtacggtacggtacgggtcggtacgggacgtacgaccgtaacgtaaccgttaggttcgggttaacgggttttcgggacggggtaaacgggttaccgtaaacggtccgttaccgggttacccggtttccggtccgggttacccgaaccgtaaccccgggtacggcccgttaaccccggcccccggttttccccggg

SEQ ID NO: 346855 - DNA, 672 bp, Homo sapiens
  misc_feature: GZ8MTXP01ARLBV.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccaggactcacctgctcgtggagaataaaggttgggggaataaatatagcttgcgtggtatcgagcgaggacggccgacggccacgtcccctgtactggtcatctatacaagataacgaacgccggacctacgaggtacctccgtagacgtcgtattcctacgtcggtccctaaccgaaccgtcgtaacggggaaccacgacgacctaaccgtccgtacgacctaacgcggaaccggcccgggacccgaacggcgtaaccgggtatacgggacggtctacggtaacttacgttacgtcgtacggaggggtccggtagggaaccgacggacacggtacgtaccgttaggttcgggttacggggtttccggggacgggttaacgggaccgtaacggttcgttaccggacccgggtttccgttacgggaacccgaccggtccccggaacggtcccgttccccggtccccccgg

SEQ ID NO: 346856 - DNA, 664 bp, Homo sapiens
  misc_feature: GZ8MTXP01BOVHR.8.12.B01.1.454.CMB.2.raw
  modified_base (510)..(510): a, c, t, g, unknown or other
  misc_feature (510)..(510): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctcgtaggagtaagtaaagttgggggaataaatatagtcttgctggtatcgagcgagacggccgaggccctacgtcccctagtactggtactagtactatacaagtataaaccgaacggccggaccctacgaacgggactacccgtcggagtacgtacgttcctcgtacggcctcccgaactacggtacgggaaacctaccgacgaccacctctacgaacctactcgaaccgggacccgggaaccccgtagggaccgtaacggagttacgacggtatacgtaacttaagtttcgngtacggacgccgggtagacaacggtcacgtacctacgtagttcgggtttgggttaccggggcggttagggtaaccaagttcccggttaccgttaccggttcccgttacgggaaccctcggggaaccccacgggtccccgttccggtccccccgg

SEQ ID NO: 346857 - DNA, 804 bp, Homo sapiens
  misc_feature: GZ8MTXP01AFH2Y.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcactgctctggagataaagtggggataaatatgcttgctggtatcgagcaggacggccagggcccacggtcccctggtacgtcggtacactcgtatacaaagaataaaccgaaacggccggacccttacgaacggggtactccccgtagacggtcgtacttccgtactcgggacctcccgtaacgtaccggtacggggaaacccaccggaacggaccctaacctttccgacggtaaacccctacgtacccggaaccggggtaacccggggaaccccgaacgggtaccggttaccgggaaagttcgggaaacggtccgttacggtaacctttaacgtttaacgttcggtacccgggtaacgggggccgggttacggggaccgtaacgggtaccgtaaaccggccgtttaaaaccccggttgggttttcggggttttacccggggggttttttcccggggggaaacccggggttaaaccgggggaaacccggtaaacgggttcccgttacccggggttaccccgtttcccgggttacgggttaacccgccgggttaaccccggacgggttccccgttaacccgggttccccccccggg

SEQ ID NO: 346858 - DNA, 720 bp, Homo sapiens
  misc_feature: GZ8MTXP01D4GZ9.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccacctcagtcgtccgtcgtccccaggacagacagccaggatcacctgctcgtaggagtaagtaaagttagggggaataaagtatgtctgctggtatacagcgagacgaccaggccacgtccctgtacgtgtacatctatacaagtaactaacgaagtaccgaccacgacggtactccgtagacgacgtacttctcgtacgacctaacctacgtacgtacgggaaccacgtacgacctactctacgaccagtacgacgaccgggaccacgggtacacggtagacgacggtacgtacgtaactttacgttaaccggtcggttaacggacgggtacggacgggggaaacctaaccggtccaaacggggtacccttaaacccggtttgggttcggggttttaacccggggttttaccggggacggggttaaaccggggtaaacccgtaaggttacccggtttaccgggttacccggttaaccggtttacccggttaaccggtaacccgtaacccgggaaccccgggttcccgttaaccccccgggtttcccccggg

SEQ ID NO: 346859 - DNA, 704 bp, Homo sapiens
  misc_feature: GZ8MTXP01BO9I9.8.12.B01.1.454.CMB.2.raw
  modified_base (256)..(256): a, c, t, g, unknown or other
  misc_feature (256)..(256): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtcccaggacagacagccaggactcacctgctctggagataaagtaggggataaatatgcttgctgtatnagcagacgcagccacgtcctgtactgtcatctatacaagataacgacgccggcctagacgggctccgagacgtcgtacttccgtacgtccgggacctccgtaaaccgtcgtaacgggaaccaccgtaccgaccaccgtctacgaacctacgtaccggaaccggacccggggaaaccccgtaggtaccggtaaccggggatacggggtaacggtaccgttaacggtaaacccttttaggtttaacccggtacgggttaccggaaccgggggttcgggtacgggaaaccgccggacgtacgtaccgttaaaccggtttgggttccgggggttttaacggggttccgggggaacggggttaacggtaaaccgtaacggttcccggttcgttacccggttcggttacggccgaacccggtcccgaacgttcccgttccccgtaacccccggg

SEQ ID NO: 346860 - DNA, 586 bp, Homo sapiens
  misc_feature: GZ8MTXP01B1DV1.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccacgtcccctgtactggtcatctatcaagataaacgaagcggaccctcgacgggactcccgtgacgcgtattctcgtggcctccaactcgtagggaaccacgacgcccactctcgaccactcgacggcccgggaaccccagggaccgtaacgggattaggacggcgttacggaacttagtttacgtgtcgaagggcggtagggacgaagctagcctaccgttaggtggttcgggtttacgggcgggttaacgggaccaaggttccgttacggttcccgtcgttcggtaaccgcgacccgacggtccgttccgtcccccg

SEQ ID NO: 346861 - DNA, 616 bp, Homo sapiens
  misc_feature: GZ8MTXP01AMGEB.8.12.B01.1.454.CMB.2.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (490)..(490): a, c, t, g, unknown or other
  misc_feature (490)..(490): n is a, c, g, or t
tcagctcgcgtgtccacgaccggtgctcgatttagtagtgtagattccgcggggctgggcctcaggaagtagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctggagataaagttagggggaataaatatgtntgctggtatcagcagacgccaggcccacgtccctgtactggtcatctatanaaagataacagccgcctcgacggactccgtgacgcgtattccgtcgtggacctaccctaacgtcgtacgggaaaccacacgaccgactctacgacccgataccgacgggacccgggaacccgacggccgtaacggacgtacggacggtcgtacgtacttacggttacgttggtacgagggtcggtcgganacgacacgtaccgtacctagggttcgtcgggtttacggggccgggtaacgggaccgtaagtccgttaccggttacgttccggttcggccgaacggcccgacggttcccgtcccggccccgttccgg

SEQ ID NO: 346862 - DNA, 554 bp, Homo sapiens
  misc_feature: GZ8MTXP01CYBWF.8.12.B01.1.454.CMB.2.raw
  modified_base (335)..(335): a, c, t, g, unknown or other
  misc_feature (335)..(335): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttgctggtatcagcagaggccaggccagtccctgtactggtcatctatacaaagataacaagccgacctcgagggactccctgacgcgattcncgtggcctccaaactcgaggaacacagtcactcagaccancgagccggacctaggctacgagngagntagacgtatacgngacgaggcgtaggacagtacacgaccgtacgttgttcgggttacgggttacgggacgggaacggaaccgtacggttccgttccggttacccgttcgtacggaaccgaccggacccgacggtcccgttccccggtccccg

SEQ ID NO: 346863 - DNA, 712 bp, Homo sapiens
  misc_feature: GZ8MTXP01A9BGL.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccacctcagtcgtccgtcgtccccaggacagacagcaggatcactgctcgtaggagtaagttaaaggttagggggaattaaatagttgcgttgcgtaggtatcgagacaggcggaccgaggccctacgtccccgtgtactggtacagtctatacaagtataacgaagtccggcctacgagggtacctcccggtagacgtacgtactttccgcgttacggcctaacccgtaacgtaccggacgggaaacccacgtacccgacctaccttactaccgaacctacgtccgggaaaccgggcccgggtaacccggaggaccggttaaccgggagttacgggacggtacttacggtaaactttacgtacgttcgggtacggacggtacggggtacggaacgaacggtcgaagttacccgtaaggttcgggtttcgggttcgggggtttaccggggacggggacgggtaaccgtaacggttccgttcggttaacccggttcggtacggtaaccgacggaccgttaacgggtcccgttaacccggttccccg

SEQ ID NO: 346864 - DNA, 696 bp, Homo sapiens
  misc_feature: GZ8MTXP01CAEAM.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggaataaatatgcttgctggtatcagcagagccaggccagtcccctgtactggtcatctatacaagataaacaagccggccctacgagggactccctggacgacgtattcctcgtcgggccctcccaaactcgtacggggaaaccacacgaccctactcgtacgaacctagccgaacggacccgggggaaccccaggggtacgtaaccgggagttgggacggtctacggtaacttagtttaaccgtgttacggacgggtccggtacggggacaggcctaataccgtaaccctttgggttaaggggtttttccgggggttttaccgggggaccgggggttaaacggggtaaacccgtaaacgggttcccggtttaccgggttaccccggttaaccgggttttcgggtaaccgtacccgggaccccttaaaccggggtcccgtttaaccccggttccccccccggg

SEQ ID NO: 346865 - DNA, 671 bp, Homo sapiens
  misc_feature: GZ8MTXP01A5ARE.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccacctcagtcgtccgtcgtccccgaggacagacagccaggatcacctgctcgtggaagtataaaggttggggaataaatagtgacgttgcgtggtatcagcaggacgccgacggcctacgtccctgtactggtactagtactatacgaagtaactaaccgaaggcccggtacctacgaacggggtacctccgtacgacgacgtacgtttcctcgtaccggtaccctcccgtaacgttccggaacgggaacctacgaccgtacctaccttccgacgaacctacgaccggacgacccggggaacccgacgggacgtacggagtacgagtcgtacgtagttacgttaggtcgtacgggtcggcgtacggggacacggactaccgacgttacctagggttcggttcggggtttacggacgggttaccggaacgtaccgggttacgttcggttacccgttaacgtcggtaaccgaccgacgttccggtcccgttaacccggtcccccg

SEQ ID NO: 346866 - DNA, 676 bp, Homo sapiens
  misc_feature: GZ8MTXP01EXLPM.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaaggacaggcagccaggatccacctgctcgtaggaagaagttaaagttagggggaataaatatgcttgctggtatcgagcgagacggccacggcccacgtcccctgtacgtcggtacattactataacgaaagtaactaaaccgacggaccggtcccgtacgacggggtacctaccgtacggacggtctacgttcctcgtacggtacctcctaacgtcgtacggaacacgacgccacttcacgaaccagccggaacggtcccgggaacccgagggtacgtaacgggagttacgggagtacctacgtaacggtttattaacggtcggttacggacgggtcggtacgggacacggcgtaacgacgtaccttaggttcggggtttagggtttccggggaacgggttacggaccgtcggcgttccgggttacccgttcgggttcgaacgtacccgtaccggacggtcccgttcccggttaacccccg

SEQ ID NO: 346867 - DNA, 739 bp, Homo sapiens
  misc_feature: GZ8MTXP01A3N18.8.12.B01.1.454.CMB.2.raw
  modified_base (320)..(320): a, c, t, g, unknown or other
  misc_feature (320)..(320): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggactcacctgctcgtaggagaataaaggttagggggaataaatatgtcttgcgtggtatcgagcgaggacggccgacggcctacgtcccctagtacgtggtaccattactaanacgaaagtaactaaaccgacggaccggtcccctaggacggtactcccgtagacgtcgtacttccgtcgtcggacctaaccgtaacctcggtaaccgggaaacaccgtacggaccctaactacgtacgaaccctacgacggaaccgggacccgggaacccgtaggaccgtaacggacgtcggaacggtactaggtaacgtttacgttaacgtcggtaccgggtaacgggtccgggtacgggaccaaacggtcccgtaagtaccccgttacgttaacgggttcggggttttaccgggggtttcccgggggaaacggggttaccgggaacccgtaacggttccggttacccggttacccggttccgttcggaacccgtacccggacccggttaaccgtccggttaacccccgttcccccggg

SEQ ID NO: 346868 - DNA, 757 bp, Homo sapiens
  misc_feature: GZ8MTXP01EMZHF.8.12.B01.1.454.CMB.2.raw
  modified_base (295)..(295): a, c, t, g, unknown or other
  misc_feature (295)..(295): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagcaggatcacctgctctggagataagtggggaataatatgtcttgctggtatcagcgagacggccacggccacgtccctgtactggtacatactntacaaagataaaccgaaggccggtaccctacgaacgggctccccgtagacggtcgtagttcctcgtacgtaccctaaccctaacgtaccgacgggaaaccacgtaccgacctaccgttcctacggaacccacgttaccggaccggggacccggggtaaaccccgagggttaccgtaaaccgggtagtaccggggaaggtccgtttaacgggtaaaacctttcggttttaaaccggttacgggccgggttaaacgggggtccggggtaacgggaaaccggtaccggacgtaaacccggtccggttaaacccgtttggggttcggggtttttaccggggtttaccgggggacgggttaaacgggttaccccgaaacggccggtttcccggaaccccggttttcggcgggttaaccaacccggggtccccgttaaacgggtccccgttcccggttcccccccggg

SEQ ID NO: 346869 - DNA, 746 bp, Homo sapiens
  misc_feature: GZ8MTXP01A7YI5.8.12.B01.1.454.CMB.2.raw
  modified_base (258)..(258): a, c, t, g, unknown or other
  misc_feature (258)..(258): n is a, c, g, or t
  modified_base (682)..(682): a, c, t, g, unknown or other
  misc_feature (682)..(682): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccgaggacagacagccaggatccacctgctcgtaggagtaagttaaaggttgggggaataaatatgtnttgctggtactcgagcgaggacggccgacggcctacgtcccctagtacgtcggtactactctatacgaaacgaactaaacgtaacggccggtaccctacggacggggtactaccgtacgacgtacgtacgttccgtccgtacgggtacccttaacccgtaaaccgttaccgggtaacgggtaaacccaaccgtaccgtaccctaaccgtcccgtaacgaacccgtaagtacccggaacggggaccccggggaaaccccgtagggtaccccgtaacgggtagacggaacggtaccgttaacgtaccggttaacggtttacccgtaggtaccgggaagggttccggaaagggcaacggtccaacggtaccgtaccgtttagggtggggttttaccggggttacgggggacgggaccggtaaaccgngttaccggttccgttacccggttcgtacggccgtacgcccgttacgtcccgttcccgtccccgg

SEQ ID NO: 346870 - DNA, 728 bp, Homo sapiens
  misc_feature: GZ8MTXP01D1GV3.8.12.B01.1.454.CMB.2.raw
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (248)..(249): a, c, t, g, unknown or other
  misc_feature (248)..(249): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccacctcagtcgtccgtcgtcccaggacagacagcaggatcactnctngganataagtaggggataatntncttgctgannagacgagcgcagccacgtcctgtactgtcatctaataacaagaactaaacgaacgccggtaccctacggacggtactcccgtggacggtacgtactttccgtacccgtcggtaccctaacccgtaacgtacccggtaacgggaaacccacgaccgtacctactaccgactaacccgttacgaccggtaacgggacccgggaaacccggacgggtaaccgttaacggggacgttacggaacgggtaccttaacgttaacgggtttaacgttacggttacggttaaacggtacggggacggttaacgggacgtacggaacgtaccgaacggttaccgttaagggtttcgggtttacggggttttcgggggacggttaaccgggggtaaccgtaaacgggttccggttccggttacccgttccgggtttacggcccgtaaaccggccccggttaacggtccccgttccccggtttcccccgg

SEQ ID NO: 346871 - DNA, 864 bp, Homo sapiens
  misc_feature: GZ8MTXP01DMZ7Z.8.12.B01.1.454.CMB.2.raw
  modified_base (278)..(278): a, c, t, g, unknown or other
  misc_feature (278)..(278): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcgagtcgtccgtcgtccccgaggacagacacgcgagatcactcgctcgtaggagtaagttaaaggttagggggaattaaagtagtgtcgttagcgtaggtacncgagacgaggaccggaccgaccggacccgaccgttccccgtacgtacgtacggtcaacttacgttaataacgaacgtaaacgtaaaccgaaaccggtccccggtacccgtacggtaacggggtaccctaccccgttaggaacgtacgttacgttccgttccgtaacggtacccttaaccgaaacgtttccgtaaacgggaaacaccctaacgaccctacctaccggtaacgaaaccccacggtacccgaacgggaaccccggggtaaaccccgaggttaaccgggtaaccgggtaaggtcgggaaacgggtttacctaacgggtttaacccttaaggtttaaacccgttccggggttaacggtacgggggaaccggtaacggggtaaccgaaaccggtacgaacccgttaccgttaaacccggttggggtttaacgggggttttcccggggtttaaccgggggaaccgggaacgggggtaaaacccctgggggaacccgtttccgggttaccccggtttaaccggtaccgggtaaacgtccccgggtacccgaacccggttcccggttaacccccggttcccccgg

SEQ ID NO: 346872 - DNA, 778 bp, Homo sapiens
  misc_feature: GZ8MTXP01EGFIE.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccaggatcacctgctctggagtataaagttgggggaataaatatgcttgctggtatcagcaggacggccaggccacgtcccctgtactggtcatctatacaagataacaacgccggtaccctacgacggggtactccccgtagacgtacgtacgtttcctccgtcgggtaccctaacccgtaaaccgttaccggttaacggggaaacccaaccgtacggacccctaccctccttaaccggtaacccaacgttaccggaaccgggaccccgggggaaaccccgacggggtacccggttaacggggacgttacggggaaccgggtaccgtttacggtaaaccggttttaacgttttaccggttacgggtttaaccgggaacgggggttaccggggtacggggaaaccgaacgggacgtaaccggtacccgtaacccgtttaaggttcggggttttacggggttttcccgggggaacgggttaacggggaacctaacgggttcccgttaccggttacccgttccggttacggtccgaccggtaccccgaagggtccccgttcccgggttaaccccccgg

SEQ ID NO: 346873 - DNA, 687 bp, Homo sapiens
  misc_feature: GZ8MTXP01AX90M.8.12.B01.1.454.CMB.2.raw
  modified_base (223)..(223): a, c, t, g, unknown or other
  misc_feature (223)..(223): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtcgtccccaggacagacagccaggatcacctgctcgtgganagtaaagtagggggaataaatatgcttgctggtatcagcgagacggaccacggcctacgtcccctgtactggtactatctactacaaagaataaaccgaacgccggaccctacgacggactcccgtagacggtctagttcctacgtcggtacctcccgtaactccggaacgggtaaccacgacgaccctacgtcctacgaaccgactacggaaccgggcccggggtaaaccccgagggtaccgttaacgggactagggacgtcgttaacgtaacggtttaagtttaccggtgtacgggtacggtaccggggtacgggaaccacgggactaaccgtaccgttaccggtagggtttcgggtttcgggggtttaccggggacgggacgggtaactacgggttccggttacggttacccggttcgtcgtaaccgacggtacccgacggtccgttccccgtaaccccgg

SEQ ID NO: 346874 - DNA, 489 bp, Homo sapiens
  misc_feature: GZ8MTXP01A7J9E.8.12.B01.1.454.CMB.2.raw
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
  modified_base (381)..(382): a, c, t, g, unknown or other
  misc_feature (381)..(382): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttgggggataaatatgacttgctggatcagcagaggcaggccagtccctgtactggtcatcatcaanataacaagcgcctgaggatcctgancgtatcnacggcncaacgcgtaggacacacgcactcncgacatcgagcggaccagtagacgnngtacgntanacgtntgacgagnggngagagacgcgtacactcgtgtcggtcggttcggcggacgacgtacgttcgttcgcgtgtcgtcgcgacgacgtcgccgtccg

SEQ ID NO: 346875 - DNA, 664 bp, Homo sapiens
  misc_feature: GZ8MTXP01ATCPL.8.12.B01.1.454.CMB.2.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtcgtccgtcgtcccaggacagacagccagatcactgctcgtgganaataagtaggggataatntgtntgcgtggtatcgagacgaggacggaccgacgggtccctaaccggttcccccgttagtaaccgttcggtacctactacttaactacaaagacttaaacgaacggccggtaccctacgaacgggtactccgtacgacgtcgtacttcgtcgtacgcctaacccgtaacgtcgtacgggaaccacgacgcctactcncgaccactacggacggaccggaacccgtaggacgtacggngttacggacgtactacggtacttagttaccgtcggtacgagggtcggtcggaacgacgacgtacgtccgtaacgtaggttcggttacgggtttcgggacgggttacggaaccgtaggttccggttcggttacccgttccggttcggtccgaaccggtcccggaacgtcccgttcccgttaacccccgg

SEQ ID NO: 346876 - DNA, 611 bp, Homo sapiens
  misc_feature: GZ8MTXP01A7HLO.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtgcctcctatgagctgactcagcccacctcagtcgtccgtcgtccccaggacagacagccaggatcactgctctaggagtataagtaggggataatatagcttgctgtatacagcgagacggacacggcctacgtccctagtaccgtggtctagtctatacgaagtaactaacgaacggccgtcccgtacgacggactcccgtaggacgtacgtacttccgtcgtaccggtacctccctaacgtcgtacgggaaccaccgacgtaccgtactacgtacaacctagacgaacggcccggaaccacggtcgtacggagaccgagtacgtacgtacttaagtcgtagtaccggaggtcgcgataccgagtacgacttacgtagtcgggttcgttacgggcggacggtaacctaggttccgttcgttccgttcccgtagccgaccggcgttacggtccgttaacccgtcccg

SEQ ID NO: 346877 - DNA, 715 bp, Homo sapiens
  misc_feature: GZ8MTXP01CG9XI.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgaggacagacagccaggatccacctgtctacgtaggaagtaagtaaaggttagggggtaaattaaatagtgtcgttagcgtaggtatacagacgaagacggccgacggccaccggtcccctagtacgtaggtcctaataccgtaatacgaaagtaacgtaaaccgaacgggtccggacccgttacgaacgggtaactcccgtaccgtacggtacgttacgtttaccgtccgtaaccggtaccctaaccgaaaccgttaccggtaaccgggaaaccaccgacgtaccctaacccgtctaccgaaccgtacacggaaccgggacccgggtaacccgacgggtaccgtaacgggatacgggtagtacgacgtacttaacgttccgttggaccagggggtaccgagggactaacgaccgtaagtaaccgttgttaacgggttcggggttcggacgggtacgggaactaaacgtcgttaggttacccgttgtaacggacgaacgccgacgcctcccgcccgttaacg

SEQ ID NO: 346878 - DNA, 601 bp, Homo sapiens
  misc_feature: GZ8MTXP01D223B.8.12.B01.1.454.CMB.2.raw
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcgagcaggacggaccaggccacgtcccctgtactgtcatctanacaagataacaagccgcctcgacggactcccngacgcgtacttctcgtacgcctccgaactcgtacgggaaacacacgaccaccttcacgaaccacgtaccgacggacccgggaacccagggaccgtacggactcggacgtactacggtaacttaagttacgtgtacgacgggtccggtaggacacgcacggcctaaccgtaggttcggttacggggtttcgggacggttaacgggtaaccaaggttcgttacgaccggttccgttggaacctacgggacccgacggtcccgttcccgtcccccg

SEQ ID NO: 346879 - DNA, 843 bp, Homo sapiens
  misc_feature: GZ8MTXP01EH9U5.8.12.B01.1.454.CMB.2.raw
  modified_base (505)..(505): a, c, t, g, unknown or other
  misc_feature (505)..(505): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcgagtcgtccgtcgtccccaggacagacagccgagactcactgctcgtaggagtaagttaaaggttaggggaattaaagtattgtcgttggcttaggtaactcgacgacaggacggaccgaacgggcctaccgtccccgtagtaacgttcggtacctaattacctaaataacgtaaaggtaaactaaacccgtaaacggcccggtaccccgtacggacggggtacccttacccgtaggacgttacgtctttcctccggtacgaccttaacccgtacgtaccggtaacgggaaaccaccgacggaccctaaaccgttccgacgtaacccgngtacccggaaccgggaccccggggaacccctaaggggtaccgtaaaccgggtgaacgggtacgttaccgtaagttaaaccggttaactttacggttaccggggtacgtacgggggtacgggtaacccggagaacccgggggttccaaacggtaccccgttttaaacgggttgggttttaacggggttttcccgggggttcgggggaaaaccgggggttacccgtaaacccggtaacggttccccggtttccgggttaccccggggttaacttaaccccggggcgggttaaccccgaccccgggttaccgggtccccgtttcccccgggttccccccgg

SEQ ID NO: 346880 - DNA, 732 bp, Homo sapiens
  misc_feature: GZ8MTXP01D6GC0.8.12.B01.1.454.CMB.2.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggacctcctatgagctgactcagcccacctcagtgtccgtgtcccaggacagacagcaggatcacctnctcgtganataaagttggggataaatntgctgctggtatacgagcagtacgcgtagcctacgtcctagtactggctatactatacaaagataaacgaacnccggacctacgtacggactccgtagacggtacgtacgtttcctactacgggtaaccttaacccgaaacgtttccgggtaaagggaacccctaaccggtaaccggaccgttaaacccctttccgggtaacgaaaccccctggttaaaccccgaacgggtacccggggaaacccccgtagggtaacccgttaaagggaaacccggtgggtaaacctacgttaaccgttaaacgggtttaaacgttaccgggtacggaaccgggtacggtacggtaacggaaaccaggtaacccttattacccgttaacgttaggttcgggggtttaagggttacccggggacggttaacggtaccgtaagttccggttaccggttaccgtcgtaacggccgaccgaccggttacgtcccgttcccgtccccg

SEQ ID NO: 346881 - DNA, 694 bp, Homo sapiens
  misc_feature: GZ8MTXP02G1E45.8.12.B01.1.454.CMB.2.raw
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagccggccctcgagggactcccgtgacgcgtacttctctcggcctccaaactcgtacggggaaaccacgaacgcccaactcctacgaccctatacgacggacccggggaaccccacggggaccgttaacccggggagttacgggaacgggtccgttacggtaaaccttaacgtttaaccgtcggttacggtaacggggcccgggttagggggaaccgaggaccgaacgaccgtaacccgttaaggtttcggggtttacggggtttttccgggggaccggggtaaacgggggtaacccgaaacgggtccgttaccgggtaaccccggttaacccggttcgggttaccgaaccggtaccccggaaacgggccccgttaccggttaccccccccgg

SEQ ID NO: 346882 - DNA, 481 bp, Homo sapiens
  misc_feature: GZ8MTXP02HMODN.8.12.B01.1.454.CMB.2.raw
  modified_base (405)..(405): a, c, t, g, unknown or other
  misc_feature (405)..(405): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctagggaacacagccactctgaccatcagcggaccaggctacggatgaggctgactattacngtcaggcgtggacagcagcactatgtggtttcggcggaggaccagctgaccgtcgtgtcacgccaggctcgccccg

SEQ ID NO: 346883 - DNA, 502 bp, Homo sapiens
  misc_feature: GZ8MTXP02HEW1C.8.12.B01.1.454.CMB.2.raw
  modified_base (408)..(408): a, c, t, g, unknown or other
  misc_feature (408)..(408): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcgagggatccctgagcgattctctggctccaactctgggaacacagccactctgacccatcagccggacccaggctacggatgaggctgactattacngtcgaggcgtgggacagacagaacctagtggtcggtttcggcggtacggaccgaagcgtacgaccgtcgtggtcacgccaggctcgcccctcgg

SEQ ID NO: 346884 - DNA, 520 bp, Homo sapiens
  misc_feature: GZ8MTXP02H3OE0.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcactgctctggagataaattggggataaatatgcttgctggtatcagcagaggccaggccagtccccctgtactggtcatctatcaagataacaagcggcctcgagggactccctgagcgattctctggctccaactctacggaacacagccactctgaccatcagccgggacccgacggctacggagtgaggctgactattacgtgtcgagggcgtagggacgagcagcactacgtgtgggttttcgggcggtacgggaccgaagccgtcgaccgtccgtcggtcgacgacccgaacggccgttcgcccccg

SEQ ID NO: 346885 - DNA, 491 bp, Homo sapiens
  misc_feature: GZ8MTXP02HMB4C.8.12.B01.1.454.CMB.2.raw
  modified_base (405)..(405): a, c, t, g, unknown or other
  misc_feature (405)..(405): n is a, c, g, or t
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatcctgagcgattctctggctccaaactctgggaacacagccactctgaccatcagcgggacccaggctacggatgaggctgactattacngtcaggcgtggacagcagcacctatggtggttttcgggcggtagggaccaagctgaccgtcgttggcagcccacggctcgcccccg

SEQ ID NO: 346886 - DNA, 499 bp, Homo sapiens
  misc_feature: GZ8MTXP02JKNKP.8.12.B01.1.454.CMB.2.raw
  modified_base (389)..(389): a, c, t, g, unknown or other
  misc_feature (389)..(389): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggntgaggctgactattactgtcaggcgtgggacagcagaacctagtgtcgggtttcggcggtagggaccaagctacgaccgtcgtggtcacgcccaaggcctcgcccctcgg

SEQ ID NO: 346887 - DNA, 533 bp, Homo sapiens
  misc_feature: GZ8MTXP02GDGOI.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcgagggactcccgtgagcgattctctggctccaactctgggaaccacagccactctgaccatcagccgggacccaggctacggatgagctgactattacgtgtcgaggcgtgggacagcagcaccgtagttggtgggttttcgggacgggtacgggaccgaacggcgtacggtacccgtccgttcggttaccgacggcccgaacggccgttccggccccccgg

SEQ ID NO: 346888 - DNA, 539 bp, Homo sapiens
  misc_feature: GZ8MTXP02GLS8F.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcaggggactccctgacgcgattcgtcgtaggctccaaactccgtagggaaccacgaacgccaactctgaacccatcgaacggccgggacccagggcctaacggatggaggctgaacttagttactgtacgaggcgtggggacaggcaggctacctattggttggtttccggacgggacgggaccgaagctacgaccgtcgttcggcacgcccgaaggccgtcgcccccg

SEQ ID NO: 346889 - DNA, 489 bp, Homo sapiens
  misc_feature: GZ8MTXP02HEWN7.8.12.B01.1.454.CMB.2.raw
  modified_base (407)..(407): a, c, t, g, unknown or other
  misc_feature (407)..(407): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctagggaacacagccactctgaccatcagcgggacccaggctacggatgagctagactattacngtcgaggcgtgggacagcatcacctatgtggtttcggcggtagggacagctgaccgtcgtggtcacgccgacgctcgccccg

SEQ ID NO: 346890 - DNA, 490 bp, Homo sapiens
  misc_feature: GZ8MTXP02HF84U.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggactcctgagcgattctctggctccaactctgggaacacacgccactctgaccatcagcggaccaggctacggatgagctagtactattactgtcgaggcgtgggacagcagcacctatgtggtttcggcggtagggaccaagctgaccgtcgtggtcacgccaggctcgtccccg

SEQ ID NO: 346891 - DNA, 517 bp, Homo sapiens
  misc_feature: GZ8MTXP02HG494.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctacgggaacacagccactctgaccatcacgcggaccaggctacggatgaggactgaactattaactgtacgaggcgtggggacaggcagcacctagttggtcggttttcgggcggtagggaccgaacgcgtcgtaccgtccgttggtacgacgacccgaaggcctcgcccccg

SEQ ID NO: 346892 - DNA, 491 bp, Homo sapiens
  misc_feature: GZ8MTXP02HFKXI.8.12.B01.1.454.CMB.2.raw
  modified_base (402)..(402): a, c, t, g, unknown or other
  misc_feature (402)..(402): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcccatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatcctgagcgatctctggctccaactctgggaacacagccactctgaccatcagcggacccaggctacggatgagctgactattacngtcaggcgtgggacagcagcactagtgtggtttcggcggagggaccaaggctggtaccgtcgttggtcacgcccaaggcctcgcccccg

SEQ ID NO: 346893 - DNA, 643 bp, Homo sapiens
  misc_feature: GZ8MTXP02HYNJI.8.12.B01.1.454.CMB.2.raw
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataaatatgctgctggtatcagcagaggccaggccagtcccctgtactggtcatctatcaaagataacaagccgccctacgagggactcctgagcgtattctctggcctccaaactcgtacgggaaacacacgaccactctcgaccactcgacggcccgggacccgacggacgtaacgggacgtaggacggcgtagtaaccttaagtttaacgtcggtacggaacgggtccgggtaggggaaccgaggaccgaacggaccctaaacccgttaacgtttacgggttcggggtttttccggggaccgggggtaacggggaacccgaaacggtcccgttaccggaacccggtttaacccggtttcgggtaccgtaccggaccccggtaaccgggcccgtacccggtcccccccgg

SEQ ID NO: 346894 - DNA, 485 bp, Homo sapiens
  misc_feature: GZ8MTXP02FV0CZ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggcctcagggatcctgagcgattctctggctccaactctgggaacacagccactctgaccatcagcgggacccaggctacgatgaggctgactatactgtcagcgtgggacagcagcacctatcgtggtttcggcggaggaccgaagctgaccgtcgtggtcacgccaggctcgtcccccg

SEQ ID NO: 346895 - DNA, 505 bp, Homo sapiens
  misc_feature: GZ8MTXP02GXXAG.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcgaggcgtgggacagcagcacctagtcggttggtttcggcggtagggaccaaggctcgaccgtcgtcggtcacgtcccgaacggcctcgtcccccg

SEQ ID NO: 346896 - DNA, 600 bp, Homo sapiens
  misc_feature: GZ8MTXP02HLYA2.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcgatctatacaagaataaacaaagacggcccgtaccgacgggacgtccctcgacgcgtacttactctcggctcctaacctactcggaacgaccacgccactctcgaccactcgacgcggggacccgacggacgtacggacgtagaggacgtcgactaactttaacgtgttcgacggcggtgggacgagcgagaccgactaacgttggttacgggttttcgggtaccggggacggggaaccgaacggacgtacggtacccggttaaccgttcgggtaccgtacggaccccgtaacgggccgttaccggtccccccgg

SEQ ID NO: 346897 - DNA, 489 bp, Homo sapiens
  misc_feature: GZ8MTXP02GAMC5.8.12.B01.1.454.CMB.2.raw
  modified_base (404)..(404): a, c, t, g, unknown or other
  misc_feature (404)..(404): n is a, c, g, or t
  modified_base (471)..(471): a, c, t, g, unknown or other
  misc_feature (471)..(471): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcggacccaggctacggatgagctgactattacngtcaggcgtgggacagcatcacctagtgttggtttcggcggtagggaccaagctgaccgtctggtcncgaccaggctcgcccccg

SEQ ID NO: 346898 - DNA, 497 bp, Homo sapiens
  misc_feature: GZ8MTXP02GVISM.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggaataaatatgcttgctggtatcagcagaggccaggccagtcccctgtactggtcatctatcaagataacaagcgcctcgaggactcctgagcgtattctctggctccaaactctgggaacacacgccactctgaccatcagccggacccaggctacggatgagctgactattactgtcagcgtggacagcagcactagtcggtaggtttcggcggtagggaccaagctcgaccgtccgttggtcacgccgacgcctcgtcccccg

SEQ ID NO: 346899 - DNA, 489 bp, Homo sapiens
  misc_feature: GZ8MTXP02JXE5C.8.12.B01.1.454.CMB.2.raw
  modified_base (405)..(405): a, c, t, g, unknown or other
  misc_feature (405)..(405): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggcctcagggatccctgagcgattctctggctccaactctggggaacacagccactctgaccatcagcgggaccaggctacggatgaggctgactattacngtcaggcgtgggacagcatcacctatgtggtttcggcggaggaccagcctgaccgtcgtggtcacgcccaggcctacgcccccg

SEQ ID NO: 346900 - DNA, 504 bp, Homo sapiens
  misc_feature: GZ8MTXP02IL0DU.8.12.B01.1.454.CMB.2.raw
  modified_base (410)..(410): a, c, t, g, unknown or other
  misc_feature (410)..(410): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccacgtcccctgtactggtcatctatcaagataacaagcggccctcagggactccgtgagcgattctctggctccaactctagggaacacagccactctgaccatcagccggacccaggactacggatgaggctgactattacngtgagcgtggacagcgagactagtggtcggtttcggcggtacggaccgaagctcgacccgtcgtcggtcacggcccaaggcctcgccccgtcgg

SEQ ID NO: 346901 - DNA, 504 bp, Homo sapiens
  misc_feature: GZ8MTXP02JPY37.8.12.B01.1.454.CMB.2.raw
  modified_base (309)..(309): a, c, t, g, unknown or other
  misc_feature (309)..(309): n is a, c, g, or t
  modified_base (472)..(472): a, c, t, g, unknown or other
  misc_feature (472)..(472): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacagcgcctnaggactcctgagcgattctctcggctccaactcgtagggaacacagccactctacgacccatcgacggccgggacccaggcgtaacggatcgacggtctagtactattacgtgtacgaggcgtgggacagcagcactagtcgtggttcggcggaggacagcgngaccgtcgttcgcacgccacggctcgtccccg

SEQ ID NO: 346902 - DNA, 493 bp, Homo sapiens
  misc_feature: GZ8MTXP02FPBUH.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagtacagacagccaggatcacctgctctggagataaattgggggataaatatgcttgctggtatcagcagaggccaggccagtcccctgtactggtcatctatcaagataacaagcggccctcagggatccctgagcgattctctggctccaactctagggaacacagccactctgacccatcagcgggacccaggctacggatgagctgactatactgtcaggcgtgggacagcagcactagtcgtggtttcggcgggtagggaccaagctgaccgtctcggtcacgccaggctcgtcccccg

SEQ ID NO: 346903 - DNA, 488 bp, Homo sapiens
  misc_feature: GZ8MTXP02FLB90.8.12.B01.1.454.CMB.2.raw
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggtttcggcggtagggacaagctgaccgtcgtggtcacgccaacggctcgccccg

SEQ ID NO: 346904 - DNA, 570 bp, Homo sapiens
  misc_feature: GZ8MTXP02FYL0R.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccgaggccacgtcccctgtactggtcatctatcaagataacagcggccctgaggactcctgacgcgtattctctcggcctccaactcgtagggaaccacacgccactctagacccatcgacggccggacccgaggacgtacggagtgagctagacttacttactgtacgaggcgtagggacagacgacgactaccgtagttcgggttgggttttaccggggacgggtaacgggaccgtaacgggtccgtacggtacccgttccgttacggtacgaccggacccgaacggtcccgtaccggtcccccgg

SEQ ID NO: 346905 - DNA, 491 bp, Homo sapiens
  misc_feature: GZ8MTXP02JPDAC.8.12.B01.1.454.CMB.2.raw
  modified_base (399)..(399): a, c, t, g, unknown or other
  misc_feature (399)..(399): n is a, c, g, or t
  modified_base (483)..(483): a, c, t, g, unknown or other
  misc_feature (483)..(483): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataaacaagcggccctcagggatccctgagcgattctctggctccaaactctaggggaacacagccactctgacccatcagcgggaccaggctacggatgagcngactattactgtcaggcgtggacagcagcactatcgtaggtttcggcggtagggacaagctgaccgtcgtgtcacgccaaggcncgtccccg

SEQ ID NO: 346906 - DNA, 518 bp, Homo sapiens
  misc_feature: GZ8MTXP02HIC8Y.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacagcgcctgagggactcctgacgcgattctctggctccaactcgtgggaacacacgcacgtctgaccatcagcggacccaggctacggatgaggctgactagttactgtacgaggcgtggacagcagcgactagtcggttcggttttcgggcgggtagggaccgaagccgtacgaccgtcgttcggtaccgacggacccgaacggccgtcgtcccccgg

SEQ ID NO: 346907 - DNA, 501 bp, Homo sapiens
  misc_feature: GZ8MTXP02JE1P9.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctgagggactccctgagcgattctctggctccaaactcgtagggaaccacacgccactctgacccatcgagccgggacccaggctacggatgagctgactattactgtcgaggcgtggacagcagcactatgtggtttcggcggaggacacgcgtcgaccgtcgttggtcacgccgaacggcctcgtcccccg

SEQ ID NO: 346908 - DNA, 497 bp, Homo sapiens
  misc_feature: GZ8MTXP02IDPXO.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgccctcagggatccctgagcgatctctggctccaactctgggaacacagccactctgaccatcagcggacccaggctacggatgaggctgactattactgtcgaggcgtgggacaggcagcacctatggtggtttcggcggtagggacgaacgcgtgaccgtcgttcggtcgacgccgacggctcgtcccccg

SEQ ID NO: 346909 - DNA, 535 bp, Homo sapiens
  misc_feature: GZ8MTXP02IH60C.8.12.B01.1.454.CMB.2.raw
  modified_base (390)..(390): a, c, t, g, unknown or other
  misc_feature (390)..(390): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccacgtcccctgtactggtcatctatcaagataacaagccgccctgagggactccctgacgcgattctctcggcctccactcgtaggggaaccacagccactctgaccatcgagccgggacccnggctacggatgagcagtactattactgtacgaggcggtaggacagacagacacgtagtggttcggtttcgggacggtaacgggaccaacgtcgtacgaccggttccgttacggaccacggacccgacggtcctaccggtcccccg

SEQ ID NO: 346910 - DNA, 506 bp, Homo sapiens
  misc_feature: GZ8MTXP02JHA1B.8.12.B01.1.454.CMB.2.raw
  modified_base (310)..(310): a, c, t, g, unknown or other
  misc_feature (310)..(310): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgccctnagggactcctgagcgattctctcggctccaaactcgtaggggaaccacacgccactctcgaccatcacgcgggacccaggctacggatgagctgactattactgtacgaggcgtggacagcagcacgtagtggttcggtttcggacggtaggaccgacgcgtcgaccgtcgtcgtcacgccgacggcctcgccccg

SEQ ID NO: 346911 - DNA, 492 bp, Homo sapiens
  misc_feature: GZ8MTXP02GZPWE.8.12.B01.1.454.CMB.2.raw
  modified_base (406)..(406): a, c, t, g, unknown or other
  misc_feature (406)..(406): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggcctcgagggactccctgagcgattctctggctccaaactctagggaacacagccactctgaccatcagcggacccaggctacggatgagctgatattacngtcaggcgtgggacagcagcactagtgtggtttcggcggagggacaagcgtcgaccgtcgtggtacacgccaaggcctcgcccccg

SEQ ID NO: 346912 - DNA, 570 bp, Homo sapiens
  misc_feature: GZ8MTXP02H089C.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacagcgccctgaggatcctgagcgattctctggcctccaactctagggaacacgacgccactctcaccatacgacggaccgggacccgacgggaccgtaacggagtaggacggacgtaggtacttaagtttacctggttacgacgggcggtacgggacgagcgagcgaccgttagtcggttgggttttacggacgggtacgggaaccgtaacgcgtaccggaccgttccgttacggtacgaccggaccgaacggtcccgtacggtccccccg

SEQ ID NO: 346913 - DNA, 495 bp, Homo sapiens
  misc_feature: GZ8MTXP02GK25K.8.12.B01.1.454.CMB.2.raw
  modified_base (410)..(410): a, c, t, g, unknown or other
  misc_feature (410)..(410): n is a, c, g, or t
tcagctcgcgtgtccacgaccggtgctcgatttagtagtgtagattccgcggggctgggcctcaggaagcagcatcggaggtgcctcagccatgacatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcaggggatccctgagcgattctctggctccaactctaggggaacacagccactctgaccatcagccgggacccaggctacggatgaggctgactattacngtcaggcgtgggacagcagcactatggttggtttcggcggacgggacaagctgaccgtcgtggtcacgccaaggctcgtcccccg

SEQ ID NO: 346914 - DNA, 499 bp, Homo sapiens
  misc_feature: GZ8MTXP02IG783.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgcctcaggatcctgagcgatctctggctccaactctagggaacacagccactctgaccatcagcgggacccaggctacggatgagctgactattactgtcaggcgtggacagcagcacctagtcgtggtttcggcggtagggaccgacgacgtcgaccgtcgtcggtacacgaccgaacggtcctcggtcccccg

SEQ ID NO: 346915 - DNA, 512 bp, Homo sapiens
  misc_feature: GZ8MTXP02HKU2C.8.12.B01.1.454.CMB.2.raw
  modified_base (411)..(411): a, c, t, g, unknown or other
  misc_feature (411)..(411): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaaagataaacgagcggccctcgagggatccctgagcgattctctggctccaactctagggaaacacagccactctgaccatcagcgggacccaggctacggatgaggctgactattacngtcaggcgtggacagcagcactagtcgtgggtttcggacggtacgggaccaagcgtacggaccgtccgttggaccgacgacccgaacgggcctcgcccccg

SEQ ID NO: 346916 - DNA, 504 bp, Homo sapiens
  misc_feature: GZ8MTXP02H2FNM.8.12.B01.1.454.CMB.2.raw
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggaataaatatgctgctggtatcagcagaggccaggccagtcccctgtactggtcatctatcaaagataacaagcggcctcagggactccctgagcgattctctggcctccaaactctacgggaacacacgccactcncgaccatcacgccgggaccaggctacgatgagctgactattactgtcgaggcgtggacngcagcacctagtgtggtttcggcggaggaccaagctacgaccgtcgtcggtacacgacccgaacggcgtcgcccccg

SEQ ID NO: 346917 - DNA, 510 bp, Homo sapiens
  misc_feature: GZ8MTXP02JS6DS.8.12.B01.1.454.CMB.2.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (392)..(393): a, c, t, g, unknown or other
  misc_feature (392)..(393): n is a, c, g, or t
  modified_base (413)..(413): a, c, t, g, unknown or other
  misc_feature (413)..(413): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggccctnaggatccctgagcgattctctggctccaactcngggaacacagccactcngaccancgacgcggaccnggcaggatgagnnactatactgtcgaggacggnggacgagcgacgacgtacgtagttcggttggttcgggtacgggacggacgacgacgtacgtaccgtcgtcgtacgacgaccgacgccgtccgtcccg

SEQ ID NO: 346918 - DNA, 690 bp, Homo sapiens
  misc_feature: GZ8MTXP02JUS61.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggaataaatatgcttgctggtatcagcagaggccaggccacgtcccctgtactggtcatctatcaagataacgaagccgccctagacggactccgtgacgcgtattctcgtcggcctccaacgtcgtacgggaacacgacgccctaactccgtacgaacccagtaccgaacggacccggggacccgacggggaccgttaacggggaacgtcggaacgggtacccttaggtaaaccgttacgttacgtcggttaccgaacggggtcggttacggggaacgacggtaccgtaaacggtaaaccctttaggtcgggttttaccggggtttaccgggacggggtaacggggtaacccgtaaacggtccgttaccgggtaaccccggtttccggtttaacggggtacccgaaaccggtacccccggtaacggccccgttcccccgggtacccccgtttcccgggg

SEQ ID NO: 346919 - DNA, 511 bp, Homo sapiens
  misc_feature: GZ8MTXP02I06BV.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggacacagccactctgaccatcagcgggaccaggctacggatgagctgactattactgtcaggcgtggacgagcagcactactcgtggtttcggttcggacgggacgaacgacgtcgtaaccgtccgttcggttcgtacgaccgaacggacgtacgtcccccgg

SEQ ID NO: 346920 - DNA, 500 bp, Homo sapiens
  misc_feature: GZ8MTXP02IYP4M.8.12.B01.1.454.CMB.2.raw
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaaagataaacaagcggcccctcagggatccctgagcgattctctagctccaactctgggaaccncagccactctcgaccatcagcgggacccacggctacggatgagctgactatactgtcaggcgtggacngcngacacctagttcgtggtttcggcgggtaggaccaagcgtgaccgtcgtggtcacgccaacggctcgtcccccg

SEQ ID NO: 346921 - DNA, 525 bp, Homo sapiens
  misc_feature: GZ8MTXP02IQBPZ.8.12.B01.1.454.CMB.2.raw
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtccccctgtactggtcatctatcaagataacaagccgccctacgagggactccctgagcgattctctcggctccaactcgtacgggaaccacgacgcccactctgaccatcgaggccggaccaggctacggatgagctgactattacngtacgaggcgtggacngcagcacgtagtcggtggtttcggacggtacggacctaacgcgtacgacccgtcgttggtaccacgacccgaacggcctccgtcccccg

SEQ ID NO: 346922 - DNA, 507 bp, Homo sapiens
  misc_feature: GZ8MTXP02FQWDQ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtacctggtcatctatcaagataacaagcggccctcagggactccctgagcgattctctggctccaactctagggaacacagccactctgacccatcagccggggacccaggctacggatgaggctgacttattactgggtacaggtcgtgggacagcatcacctagtcgttggtttcggcggtagggacagctcggaccgtcgttgtcacgcccaggcctcgtcccccg

SEQ ID NO: 346923 - DNA, 523 bp, Homo sapiens
  misc_feature: GZ8MTXP02GMOWX.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggacacagccactctgaccatcagcggacccaggctacggatgaggctgactattactgtacgaggcgtgggacagcgagcacctagtcggttggttttcgggacgggtagggaccaagccgtacggtaccgtccgttcggtacgacggtacccgaacggtccgtacgtccccccgg

SEQ ID NO: 346924 - DNA, 527 bp, Homo sapiens
  misc_feature: GZ8MTXP02I3FCA.8.12.B01.1.454.CMB.2.raw
  modified_base (310)..(310): a, c, t, g, unknown or other
  misc_feature (310)..(310): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacagcgccctnagggactcctgagcgattctctggctccaactcgtacgggaacacacgccactctcgaccatcgacggcgggacccaggctacggatgacggctcgactattactgtcgaggcgtgggacagcgagctaaccgtagttggttgggttttcgggcgggtaacggggaccgaacgcgtcgaccgttccgttggtcacgcccgaacggcctcgtcccccg

SEQ ID NO: 346925 - DNA, 617 bp, Homo sapiens
  misc_feature: GZ8MTXP02F2XJX.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggccctcagggactcccgtgagcgattctctcggctccaaactcgtagggaaccacacgccactctcgacccatcgacgccgggacccacgggaccgtacggacgtaggaacggtcgtaggtacttacgttaacgtcgttacggaacgggtcggtacggggaacgacggaccacggaccgtacccgtaagttacggttacggggtttttcggggaccggggttaacggggaaccgaaacggtccgtacggtaacccggtccgttcgggttaccgacggaccccgtaaacggcccgtacccggtccccccggg

SEQ ID NO: 346926 - DNA, 591 bp, Homo sapiens
  misc_feature: GZ8MTXP02FM3BN.8.12.B01.1.454.CMB.2.raw
  modified_base (280)..(280): a, c, t, g, unknown or other
  misc_feature (280)..(280): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagcttgactcagccaccctcagtgtccgtgtccccaggacagacgagccaggatcaccgtgctctggagataaagttggggataaatatgcttgctggtatcagcagaggccaggccagtccccngtactggtcagtctatcaagataacaagcggaccctacagggactccgtgagacgtattctctggcctccaactcgtaggggaaccacacgcccaactcctgaacccatacaacggccgggaacccacgggacctaacgggaagaggacgctacgtaacttacttacgtcggtacggagggtcggtagggacgacggacgacgacctacgttagttcggtttcgggtttcgggacggggtaacggaccgacgtccgtacggtaccggttcgtacggtaccgacggaccggaacggtccgtacccgtccccg

SEQ ID NO: 346927 - DNA, 514 bp, Homo sapiens
  misc_feature: GZ8MTXP02I1RSH.8.12.B01.1.454.CMB.2.raw
tcagctcgcgtgtccacgaccggtgctcgatttagtagtgtagattccgcggggctgggcctcaggaagcagcatcggaggtgcctcagccatgacatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtccccctgtactggtcatctatcaagataacaagcggccctcgagggatccctgagcgattctctcggctccaactctagggaaccacagccactctgaccatcaggcggacccaggctacggatgaggctgactattactgtcaggcgtgggacagcgagcacctatcggttggttttcgggcgggtagggaccgaacgcgtcgaccgtcgttcggtcgacgcccgaacggcgtcgtcccccg

SEQ ID NO: 346928 - DNA, 511 bp, Homo sapiens
  misc_feature: GZ8MTXP02INZNR.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaaagataaacaagcggccctcgagggatccctgagcgattctctggctccgaactctgggaaccacagccactctgaccatcagcgggaccacggctacggatgagctgactattactgtcgaggcgtggacagcagcacctagtcgttggttttcggcgggtaggaccgaacgcgtcgaccgtcgttcggtcgacggaccaacggtcctcgtcccccg

SEQ ID NO: 346929 - DNA, 506 bp, Homo sapiens
  misc_feature: GZ8MTXP02HO8QL.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaaagcggcctcgaggggatccctgacgcgattctctcggctcccaaactctacggggaaccacacgccactctgacccatcagcgggacccaggctacggatgagctgactatttactgtcaggcgtggacagcagcacctatgtggtttcggacggagggaccaagctggacctccgtggtccacgccacggcctcgtcccccg

SEQ ID NO: 346930 - DNA, 550 bp, Homo sapiens
  misc_feature: GZ8MTXP02HUQ6F.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcgcctcgaggactccctgagcgattctctcggctccaactcgtaggaaccacacgcctactctacgaccatcgacggccgggacccacggcgtacggagtaggacggctacggacttacgttactcggtcgaggtcggtgggacgaggcagacaccgtgttggttcgggttttcgggacggtacgggaccgaacgccgtcggaccgttccgttcggccgacgacccgaacggtccgtcgtcccccg

SEQ ID NO: 346931 - DNA, 492 bp, Homo sapiens
  misc_feature: GZ8MTXP02GMW8K.8.12.B01.1.454.CMB.2.raw
  modified_base (311)..(311): a, c, t, g, unknown or other
  misc_feature (311)..(311): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctnagggactcctgagcgattctctcggctccaactcgtgggaacacagccactctgaccatcagcggacccaggctacggatgaggctgactattactgtcaggcgtggacagcagcacgtatcgtggtttcggcgggaggaccagctgaccgtcgtcggtcacgaccacggcctcgtccccg

SEQ ID NO: 346932 - DNA, 516 bp, Homo sapiens
  misc_feature: GZ8MTXP02GK2KA.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgcctcagggactccgtgagagattctctggctccaactctagggaacacacgccactctcgaccatcacgccgggacccaggctacggatgagctagactattactgtcgaggcgtagggacagcagcacgtatcggttggtttcgggcggtacgggacaaggccgtagtacccgtcgtcggtaccgacgacccgaaggcctcgtcccccg

SEQ ID NO: 346933 - DNA, 525 bp, Homo sapiens
  misc_feature: GZ8MTXP02HJR29.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacaggcagccaggatcacctgctctggagataaagttggggataaatatgcttgctggtatcagcagaggccaggccagtcccctgtactggtcatctatcaaagataacaagcggccctcaggggactcccgtgagcgattctctcggctccaactctaggggaaccacacgccactctagacccatcgacggccggacccaggcgtacggataggaggtctcggtacttagttacgtgtacgaagggcgtgggacagcaggcacctagtcgtcgggtttcggcggacggacagcgtcgaccgtcgttggtcacgccacggcctcgtccccg

SEQ ID NO: 346934 - DNA, 537 bp, Homo sapiens
  misc_feature: GZ8MTXP02JS7D2.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttgctggtatcagcagaggccaggccagtcccctgtactggtcatctatcaagataacaagcggccctacagggactcctgagcgattctctcggctccaactcgtagggaaccacacgccactctcgaccatcgagccgggacccaggactacggatgaggctagactattacgtgtcgaggcgtgggacagcagaacctagtggttcgggtttcggcgggacgggtaccgaacgtccgtacggtacccgtccgttggaccacggaccctaaggccctccggcccccgttccgg

SEQ ID NO: 346935 - DNA, 542 bp, Homo sapiens
  misc_feature: GZ8MTXP02HVX9W.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcgccctcagggactcctgagcgattctctggctccaactctgggaaccacacgccactctacgaccactcgacgccgggacccgacggctacggagtgacggactgactactttacgtgtacgaggcggtaggacgagcagacaccgtagtacggttcgggttttcggacggtacgggaaccgacgcgtacgtaccggtccgttcggtacgacggacccgacggccgtccgtcccccg

SEQ ID NO: 346936 - DNA, 508 bp, Homo sapiens
  misc_feature: GZ8MTXP02JR2IY.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacagcggcctcgagggatccctgagcgattctctggctccaaactctagggaacacacgccactctcgaccatcgagccggacccaggctacggatgagctgactattactgtcgaggcgtgggacgagcagacactagtcgtgggtttcggcgggtacgggaccacgcgtcgaccgtcgtcggtcgacgccgacggccgtcgtccccg

SEQ ID NO: 346937 - DNA, 588 bp, Homo sapiens
  misc_feature: GZ8MTXP02G67QO.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcgccctgaggactcctgagagattctcgtggctccaactctagggaacacagccactctcgaccatcacggccgggacccaggccgtacggatacggacggctaggaacttagtttacgtcggttcgaacggtcggtacggggaacagacgacggacacccgtaagttcgggttcggggttttaccgggacggggtaacggggaaccgaacggtccgtcggtaacccggttccgttacggtaccgaccggaccccgtaacgggcccgttacccggtccccccgg

SEQ ID NO: 346938 - DNA, 542 bp, Homo sapiens
  misc_feature: GZ8MTXP02GJ4KO.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatacaaaataacaagcggccctcagggatcccgtgacgcgattctctggcctccactctgggaaacacacgccactctagaccatcgacgcgggacccaggcctacggatgaggctgactattactgtcgaggcgtggacagcgaagaaccttagtggttacgggtttcggacgggtaagggaccgaaaggctacggacccgttccgtttgggccacggaccccgtaaggcccgtcgcccccgttcggtaccc

SEQ ID NO: 346939 - DNA, 561 bp, Homo sapiens
  misc_feature: GZ8MTXP02JVVDW.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggatcacctgctctggagataaattggggataaatatgcttgctggtatcagcagagccaggccagtcccctgtactggtcatctatcaagataacaagcgccctcgagggactccctgacgcgtattctctggctccaactcgtacgggaacacagccactctagaccatcagcggacccaggctacggatgagctgactattacgtgtacgaggcgtacgggacaggcaggcctaaccgtagttcggtttacggggtttacgggacgggtaacgggtaacccgaacgtccgttacggaaccccggttcgttaccgggtaccgacggtacccgaacgggtcctaccggtccccccgg

SEQ ID NO: 346940 - DNA, 529 bp, Homo sapiens
  misc_feature: GZ8MTXP02IGCAQ.8.12.B01.1.454.CMB.2.raw
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataaatatgcttgctggtatcagcagaggccaggccagtcccctgtactggtcatctatcaagataaacaagcggccctcgaggactccctgagcgattctctggcctccaactctacgggaacacacgccactctgaccatcgagccggacccnggctacggatggagctagactatttacngtcgaggcgtggacaggacagaaccgtagtggttacgggtttcgggacgggaggtaaccgaaacgcgtacgtaccgtcgttggtaccacgacccgaagtcctcgcccccgtcgg

SEQ ID NO: 346941 - DNA, 592 bp, Homo sapiens
  misc_feature: GZ8MTXP02FT997.8.12.B01.1.454.CMB.2.raw
  modified_base (274)..(274): a, c, t, g, unknown or other
  misc_feature (274)..(274): n is a, c, g, or t
  modified_base (383)..(383): a, c, t, g, unknown or other
  misc_feature (383)..(383): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcactgctctggagataagttggggaataaatatgcttgctggtatcagcagagcagccacgtccccngtactggtcatctatacaagaataacagccggccctacgaggactcctagacgcgtacttctcgtcggcctccactcgtaggaaaccacacgccaacttcacgacctanacgacggaccggacccgaggtacgtaacggagacggacggtactacggtaactttaacgttacgtacgttacgggtagggtacccggtaggggaacacgggacacgaccgtaccgttaaggttcggtttcgggtttacggggacgggaaacggacgaacgtcgacgtaccgttaacgtcgacgacggaccaacggcctccgtcccccgg

SEQ ID NO: 346942 - DNA, 501 bp, Homo sapiens
  misc_feature: GZ8MTXP02H2J36.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctacgggaacacacgccaactctgacccatcagccgggacccacggctacggatgagctgactattactgtcaggcgtggacagcagcactagtcgtggtttcggcggaggaccgaagcgtcgaccgtcgtcggtcacggcccaacggctcgcccccg

SEQ ID NO: 346943 - DNA, 506 bp, Homo sapiens
  misc_feature: GZ8MTXP02I58KN.8.12.B01.1.454.CMB.2.raw
  modified_base (382)..(382): a, c, t, g, unknown or other
  misc_feature (382)..(382): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcgcctcaggatccctgagcgattctctggctccaactcgtagggaacacacgccactctgaccatcacgccggacccnggactacggatgaggctagactattactgtcgaggcgtggacagcagcacgtatggttggtttcggcgggtaaggaccaagcgtcgaccgtcgtggtaccacgacccacggccttccgcccccg

SEQ ID NO: 346944 - DNA, 637 bp, Homo sapiens
  misc_feature: GZ8MTXP02ITJ8A.8.12.B01.1.454.CMB.2.raw
  modified_base (294)..(294): a, c, t, g, unknown or other
  misc_feature (294)..(294): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtcccctgtactggtcatctatnaaagataaacaagcgacctcgagggactcccgtgacgcgtattctcgtgctccaactcgtacgggaaaccacagacctactcctacgaacccatcaacggccgggaacccacgggaccgtaaccgggatacgggacggtacgtacgtaacgttaaactttacgtcggttaccgagggtaccggtaggggacgacggacgaacggacctaaccgtaggtttagggttcggggttttacggggaccggggttaacggggaaacccgaacggtaccgttaccggtacccgttccggttcggttaccgaccggaccccggtaacggtccgtacccggtcccccccgg

SEQ ID NO: 346945 - DNA, 674 bp, Homo sapiens
  misc_feature: GZ8MTXP02HD5V0.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccagtcccctgtactggtcatctatcaagataacaagcggcctacgaggactcctgagcgattctctcggctccaactcgtacgggaacacgacgccactctcgaacccataccgacggacccgggggaccccacggggaccgtaaccggggtatacgggacggtacgtacggtaaaccttacgtttaacgtggttaccgaaaggggcccggttagggggaactaacggggccaaggtacccgtaaacccgttaaggtttacgggtttcggggtttttaccgggggaccggggttaaaggggaaccccgtaaagggtccgtaccgggtaaccccggtttccggtttcgggttacccgtaaaccgggtacccccgaaacggggtcccgttacccgggttacccccccgg

SEQ ID NO: 346946 - DNA, 490 bp, Homo sapiens
  misc_feature: GZ8MTXP02JCEK4.8.12.B01.1.454.CMB.2.raw
  modified_base (311)..(311): a, c, t, g, unknown or other
  misc_feature (311)..(311): n is a, c, g, or t
  modified_base (405)..(405): a, c, t, g, unknown or other
  misc_feature (405)..(405): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctnagggatccctgagcgattctctggctccaactctgggaacacagccactctgaccatcagcgggacccaggctacggatgagctgactattacngtcaggcgtgggacagcagcactagtgtggtttcggcggtaggaccaagctgaccgtcgttggtcacgcccgacgctcgtccccg

SEQ ID NO: 346947 - DNA, 546 bp, Homo sapiens
  misc_feature: GZ8MTXP02HQ64X.8.12.B01.1.454.CMB.2.raw
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggaataaatatgcttgctggtatcagcagaggccaggccagtcccctgtactggtcatctatcaaagataacaaagcggccctcagggatcccngagcgattcnctggctccaaacttcaggaacacagccactccncacacacacgacggaccgacgacgacgagagagacgtagactattactagtacgaggacggtacggacgacgacgacgacgacgtacgttacggttcgggtttcgggtacgggacgggaaccgaacgacgtacgtaccgttccgttcggtacgacgaccgaccggaccgtccgtccccg

SEQ ID NO: 346948 - DNA, 523 bp, Homo sapiens
  misc_feature: GZ8MTXP02HBD2X.8.12.B01.1.454.CMB.2.raw
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggatcacctgctctggagataaagttggggataaatatgcttgctggtatcagcagaggccaggccagtcccctgtactggtcatctatcaaagataaacaaagcggccctcagggactcccgtgagcgattctctggctcccgaaactctagggaaaccacagcccaactctcgaccatcgagcccggacccaggctaacggagtagaggctagactatttacngtcgaggcgtgggacagcancacctagtcgttggtttcggcggaggaaccacgctggaccgtcgtcggtacacgcccgaggccgtacgtcccccg

SEQ ID NO: 346949 - DNA, 590 bp, Homo sapiens
  misc_feature: GZ8MTXP02FUWV9.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggactcacctgctcgtggagaataaagttggggaataaatatgtcttgcgtaggtatcagcgaggacggccacggcctacgtcccctgtactggtacatctatacaagaactaacgaacggccggaccctacgaggtactcccgtagacgtcgtattctcgtcggcctaccgtaactcgtacggaaccacacgccactctacgaccagtcgacggccggacccgaggacgtacggagtagacgtacgtacgtaacttattacgtcgtacggaggtccggaggaccaggacgacgactacgttagttcgggttcgggtttacgggacgggtacggacgacgtacgtcggtaccgtcgtcggtcacggccgacgtccgtccgtccccg

SEQ ID NO: 346950 - DNA, 592 bp, Homo sapiens
  misc_feature: GZ8MTXP02HI5QS.8.12.B01.1.454.CMB.2.raw
  modified_base (332)..(332): a, c, t, g, unknown or other
  misc_feature (332)..(332): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
tcagctcgcgtgtccacgaccggtgctcgatttagtagtgtagattccgcggggctgggcctcaggaagcagcatcggaggtgcctcagccatggcatggatcccctctcttcctcggcgtccttgcttactgcacaggatccgtggcctcctatgagctgactcagccaccctcagtgtccgtgtccccagggacagacagccaggatcacctgctctggagataagttggggataaatatgacttgctggtatcagcagagcctaggccagtcccctgtactggtcatctatcaagataacaagcgcctgagggactcctgagcgattcnctcggctccaacttcagggaacacacgccacnctcgaccancagccggaccacggctacggacngaggctaggtactattaaccgtgtacgacggccggtagggacacggacgacggacaacccgttagttcggttcggggttttccgggacggggttacgggaacccgtaaaggcccgttaacggtcccggttaacccggtttaacggggtccgaaccggtaccccggtaaccgggccctttacccggtcccccccggg

SEQ ID NO: 346951 - DNA, 583 bp, Homo sapiens
  misc_feature: GZ8MTXP02JYXJO.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagacggccacggccacgtcccctgtactggtcatctatacaagataacagccgccctgacggactccgtagacgcgtattctcgtcggctccaactcggtacgggaaccaccgacgaccctactcctacgaacccagtaccgacgggacccggggacccgacgggaccgtaaccggagtcggaacggctagtaacttacttacgtgtacggaggcggtagggacaggcacggcaccgtagttcggttcggtttcgggcgggtacggaccgaacgtccgtacggtaccgtcgtcggtaccacggcccgaacgccgtccgtcccccgg

SEQ ID NO: 346952 - DNA, 605 bp, Homo sapiens
  misc_feature: GZ8MTXP02IV412.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacagccgcctgacggactcctgagcgtattctctcggctccaactcgtacgggaaccacgacgacccactctacgaccatcgacggcccgggacccgagggcctaacgggatcggacggactacggtaacttacttacgtcgtacggaaggtcggtacggggacaggccgagaccgtaacgttagttcgggttacgggttttccggggacgggtaaacggggaccgtaaacggccgttacggtaacccggttccggttacggttaccgaccggacccgtaacgggtcccgttacccggtcccccgg

SEQ ID NO: 346953 - DNA, 501 bp, Homo sapiens
  misc_feature: GZ8MTXP02ITXDE.8.12.B01.1.454.CMB.2.raw
  modified_base (312)..(312): a, c, t, g, unknown or other
  misc_feature (312)..(312): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggccctnagggactccctgagcgattctctcggctccaactcgtacggggaaccaccagcccactctcgaccatcacgccggacccaggctacggatgagctagacgtattacgtgtacgagcggtggacagcagcactagtcggtgtttcggcggaggacagctcgacgtcgtgtcacgccacggctcgtccccg

SEQ ID NO: 346954 - DNA, 617 bp, Homo sapiens
  misc_feature: GZ8MTXP02HOOS7.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatccacctgctcgtggagtaagtaaaggttggggaattaaatatgtcttgctggtatcagcaggacggccaggcccacgtcccctgtactgtcatctatacaagacaaacaacggccgacctacgacgggtactcccgtgacgacgtacttctcgtacggtcaccgtaaactcgtaacggggaaccacgacgaccctactaccgtacaaccctagtaccgaccggacccggggaacccgacggacgtaacggagaggacggtactacggtaaactttacgtttaaccgtggttacggacgggacggtacgggacgacggcacggacctacgttaggttcggttacggggtttcggacgggtacggacgacgcgtcgaccgtcgtgtcgacgaccacgcgtccgtccccg

SEQ ID NO: 346955 - DNA, 492 bp, Homo sapiens
  misc_feature: GZ8MTXP02G3BGB.8.12.B01.1.454.CMB.2.raw
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (474)..(474): a, c, t, g, unknown or other
  misc_feature (474)..(474): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcgcctcgagggactccctgagcgattctctggctccaaactcgtagggaaccacagcccactctagaccancaggccggaccaggctacggangagctgactattacngtcgagcgtaggacngcagcactatgttgggttcggcggaggacacgctcgacgcgttgacncgaccacggctcgccccg

SEQ ID NO: 346956 - DNA, 502 bp, Homo sapiens
  misc_feature: GZ8MTXP02HFFBE.8.12.B01.1.454.CMB.2.raw
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtccccctgtactggtcatctatcaagataacaagcgccctnagggactcctgagcgattctntggctccaaactctagggaacacagcccactctgaccatcagcggacccaggctacggatgagctagactattacngtcaggcgtggacngcagcaactntgtggtttcggcggtagggaccaagccgtagaccgtcgttcggtcacgcccgaacggcctacgcccccgg

SEQ ID NO: 346957 - DNA, 557 bp, Homo sapiens
  misc_feature: GZ8MTXP02GLDCR.8.12.B01.1.454.CMB.2.raw
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggataaatatgcttgctggtatcagcagaggccaggccacgtcccctgtactggtcatctatcaagataacaagccggccctcgaggactccctagacgcgtattctctcggctccaacgtcgtacgggaacacacgccactctcgaccatcgaggccgggacccgaggcacggatgacggntgacttattactgtacgaggccgtaggaccnggcaggctacctagttcggttacgggtttcgggacgggtacgggaaccctaaggccgtacgtacccggttcgtttcggaccgacggcccgaaacggtcccgtaccggtcccccg

SEQ ID NO: 346958 - DNA, 610 bp, Homo sapiens
  misc_feature: GZ8MTXP02FPRTO.8.12.B01.1.454.CMB.2.raw
  modified_base (311)..(311): a, c, t, g, unknown or other
  misc_feature (311)..(311): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttgctggtatcagcagaggccaggccagtcccctgtactggtcatctatcaagataacaagcggccctnagggactccctgacgcgattctcgtcggcctccaaactcgtacggggaaccacgaacgcccaactctcgaccctacgcacggccggggacccgacgggactaccgggagtacggacgggtacgtcggtaacttacgttaacgtggttaccggagggtccggtacggggacacggacacgaccgtaccgttagttggttcgggttttaccggggacgggtaacgggacgacggtacgtccggtaacccggttccgttcgggtaccacggaccccgaacggtcccgtaccgttccccccgg

SEQ ID NO: 346959 - DNA, 513 bp, Homo sapiens
  misc_feature: GZ8MTXP02I9G1E.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgccctcagggactccctgagcgattctctgctccaactcgtagggacacagccactctcgaccatcacgcggacccacggctacggatgagctagactattactgtcgaggcgtgggacagcgagcaccgtatcggttcggtttcggcgggtacggacgaacgcgtcgaccgtcgttcggtacgacgacccgaaggcctacgtcccccg

SEQ ID NO: 346960 - DNA, 546 bp, Homo sapiens
  misc_feature: GZ8MTXP02IZP5H.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgccctcagggatccctgacgcgattctctggcctccaactcgtacgggaacacacgcccactctagacccatcgagccggacccaggcgtacggatgagctagactattacgtgtcgaggcgtagggacagacaggcaccgtagtggttcgggtttcggcgggtacgggacctaacggtcgtacggtacccgttccgttaggggttccacggaccccgtaaacggccgtccggtccccccgg

SEQ ID NO: 346961 - DNA, 529 bp, Homo sapiens
  misc_feature: GZ8MTXP02IQRKA.8.12.B01.1.454.CMB.2.raw
  modified_base (494)..(494): a, c, t, g, unknown or other
  misc_feature (494)..(494): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataatatgcttgctggtatcagcagaggccaggccacgtcccctgtactggtcatctatcaagataaacaagcgcctcgagggactcccgtgacgcgattctcgtcggctccaaactcgtacgggaacacgacgcctactctagacccatcgacgcccgggacccagggaccgtaacggagtcggaggactaggtactaatttacgtcgtacggaggcggtaggacagcagcactagtgtgtttcgggcgacggacacgcncgaccgtcgtggtacacgaccacggcctcgccccg

SEQ ID NO: 346962 - DNA, 512 bp, Homo sapiens
  misc_feature: GZ8MTXP02JUBZJ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgcctcgagggactcccgtgacgcgattctcgtcggcttccaaactctagggacacagccacgtctcgaccatcgacgccgggaccaggactacggatgaggctagactataccgtgtcgaggcgtggacaggcagcactatggtcggtttcggcggtacggacgacgcgtagtaccgtcgtacggtcacgccgacggctccggccccg

SEQ ID NO: 346963 - DNA, 487 bp, Homo sapiens
  misc_feature: GZ8MTXP02GEQD2.8.12.B01.1.454.CMB.2.raw
  modified_base (394)..(394): a, c, t, g, unknown or other
  misc_feature (394)..(394): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccaggatcacctgctctggagataaattgggggataaatatgcttgctggtatcagcagaggccaggccagtcccctgtactggtcatctatcaagataaacaagcggccctcagggactcctgagcgattctctggctccaactctagggaacacagccactctgaccatcacgcggacccaggctacggancgagctgactattactgtcaggcgtggacagcagcactatgtggtttcggcggaggacaacgctgacgtcgttgcacgccaagctcgtccccg

SEQ ID NO: 346964 - DNA, 641 bp, Homo sapiens
  misc_feature: GZ8MTXP02HYVEL.8.12.B01.1.454.CMB.2.raw
  modified_base (292)..(292): a, c, t, g, unknown or other
  misc_feature (292)..(292): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctancaagataacaagcgccctgagggctcctgagcgattctctggctccaacttctacggggaaaccacgacgccactctcgacccatcgacggccgggacccgacggacgtacgggaactggacggacgttagtaacgttaactttacgtacggttcggaacgggtacggtacgggaacgacggacgaacgaccgtaacccgttaagtttcgggttacggggtttttacgggggaccggggttaaccgggggaaacccgtaacgggtaccgttaccggtaacccggttaacccggtttcgggttaccgaccggtaccccgaaaccgggtcccgttacccggtcccccccgg

SEQ ID NO: 346965 - DNA, 580 bp, Homo sapiens
  misc_feature: GZ8MTXP02HHBSK.8.12.B01.1.454.CMB.2.raw
  modified_base (438)..(438): a, c, t, g, unknown or other
  misc_feature (438)..(438): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccagtcccctgtactggtcatctatcaagataacaagccggccctacgagggactcccgtgacgcgtattctcgtggcctccaacgtctacggggaaccacgacgccctaactctcgaccatcgacggcccgggaccacggctacggatgaggtactggaactatttaccgngtcgacggtcggtggaacacgctaatccgtacctagttagttcggggttttcgggacgggtaacgggtaccgaaacggtccgtacggacccggttccgttcgggtacccacggacccgtaacggtccgtaccgtccccccgg

SEQ ID NO: 346966 - DNA, 560 bp, Homo sapiens
  misc_feature: GZ8MTXP02HMW5E.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggccctcgagggactccctgacgcgtatttctcgtcggcctccaaactcgtacggggaaccacgacgacctactcctcgaccactcgacggccgggacccacggcgtacggagtcgaacggctagacttacttacgtgttcgagggcgtgggacgagcagactacgtagttcggttcgggttttcggcgggtacgggaccgacgacgtcgtaccgtccgttcggtaccgtacgaccgacggccgtacgtcccccg

SEQ ID NO: 346967 - DNA, 686 bp, Homo sapiens
  misc_feature: GZ8MTXP02JOZNG.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggatcacctgctctggagataaagttggggataaatatgcttgctggtatcagcagaggccaggccagtcccctgtactggtcatctatcaaagataacaacgccggccctacgagggactcccgtagacgcgtattcctcgtcggcctccgaactcgtacgggaaccacgacgcccacctcgtacgaacccactcgacggacccggggaccccacggggtaccgtaaccggggagtacggacgggtaccgtacggtacctttaacgtttaccgttacggtacggaacggggtccgggtacggggaacgtaacggacgtaaccggccgtaacccgttaagtttcggggtttacggggttttaccgggggacgggggtaaacggggtaaccgtaacggtaccggttaccggtacccggtttaacccggttacggttaccgtacgggacccccgaacgggtcccgtacccggtttcccccccggg

SEQ ID NO: 346968 - DNA, 547 bp, Homo sapiens
  misc_feature: GZ8MTXP02H0QYH.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtacctggtcatctatcaagataacaagcggccctgagggactccctgacgcgtattctctggcctccaaactcgtacgggaacacacgccactctcgaccatcacgcgggacccacggacgtacggagtagacggctagaacgtatttactcgttacgaggtcggtagggacagcaagcaccgtagttcggttggttttcgggcggacgggaccaacggtcgtacgaccgtccgttcggtacgaccgacccgacggctaccgtcccccg

SEQ ID NO: 346969 - DNA, 623 bp, Homo sapiens
  misc_feature: GZ8MTXP02JG90F.8.12.B01.1.454.CMB.2.raw
  modified_base (217)..(217): a, c, t, g, unknown or other
  misc_feature (217)..(217): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcnggagataagttggggataaatatgcttgctggtatcagcagaggccaggccacgtcccctgtactggtcatctatacaaagactaaacaacggccggccctacgacgggactccctgacgcgtattcctacgtcggcctccgaacttcgtacggggaacacgacgcctactcctacgaccatcgacggcccgggacccagggcgtaacggagtcggacggtctcgtaacttacgttaacgtggttacgagggtcggtacgggacagggacaacggacctaaccgttagtttcgggttacgggttttaccggggacggggtaacgggtaacccgtaacggtcccgtacggtaacccgtccggttcggtaccgaccggacccgaacggtcccgtaccgtccccccggg

SEQ ID NO: 346970 - DNA, 535 bp, Homo sapiens
  misc_feature: GZ8MTXP02ITQLZ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagcggccctgagggatccctgacgcgattctctggctccaactctagggaaacacagccactctcgaccatcacgccggaccacgctacggatgagctgactattactgtcgaggcgtgggacacgcacgacacctagtggttcgggtttcggcgggtaacgggaccgaacggtccgtacggtacccgtccgttacggtaccgacgacccgtaacggccgtaccgtcccccgg

SEQ ID NO: 346971 - DNA, 591 bp, Homo sapiens
  misc_feature: GZ8MTXP02GXGGK.8.12.B01.1.454.CMB.2.raw
  modified_base (471)..(471): a, c, t, g, unknown or other
  misc_feature (471)..(471): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtcccctgtactggtcatctatacaagataaacagccggccctcgagggactccgtgacgcgtacttctctcggctccaacgtcgtacggaaccacgacgccactctcgaaccctagccgacggacccgggacccagggcgtaaacggatacggaacgcttacgaacttagttacgtggtacgacggtcggtagggaacncggtacaactaccgtaccgttagttcggtttcggggtttacggacgggtaagggtacccgaagtccgtacggacccgtttcgtacggtaccacggaccctaacggcctcccggtcccccg

SEQ ID NO: 346972 - DNA, 637 bp, Homo sapiens
  misc_feature: GZ8MTXP02IUX4A.8.12.B01.1.454.CMB.2.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (405)..(405): a, c, t, g, unknown or other
  misc_feature (405)..(405): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctgganataaagttggggataaatatgcttgctggtatcagcagaggccaggccacgtcccctgtacnggtcatcatcaaagataacaagcggccctgacgggactcccgtgacgcgtattctcgtcggcctccaactcgtagggaaacacgacgccaactctgacccatcgacggcccggggaacccncgggactaccgggataggacggtcgtaacggtacttaacgttaccgtcggttacgaacgggccgggtaggggaacacggaccgtacggacctaacccgtttaagttcgggtttacgggggtttttccggggcgggggttaaacggggaaccgtaaacggtccgttaccggtaacccggtttcgttcggggttacaccggacccgtaaacggtcccgtacccggttcccccgg

SEQ ID NO: 346973 - DNA, 720 bp, Homo sapiens
  misc_feature: GZ8MTXP02IUJ6I.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctggagataaagttggggaataaatatgtcttgctggtatcagcagacggccaggccacgtcccctgtactggtcatctatcaagataaacgagccggccctagacgggactcccgtagacgagtacttcgtactcggtcctcctaacgttcgtacgggaaaccaccgacggaccctactacccgtacgaaccctacgtaccggacgggacccggggaaaccccacggggtaccttaacggggatacgggaacggtaccgttacgtaacgttacgtttaacgtcggtacggtacggggacggttacgggaacctacggacctacggacctaaaacccgttaggtttcggggtttacgggggtttttaccgggggacccggggtaaacgggtaacccgtaaacgggtcccgttaacccgggtaacccggtttcccggttacggggttacccgtaacccgggaccccggtaaccggttcccccggtaaccccggtttcccccccgg

SEQ ID NO: 346974 - DNA, 563 bp, Homo sapiens
  misc_feature: GZ8MTXP02JN4HI.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagacggcaggccacgtcccctgtactggtcatctatacaagataaacgaagccggccctgacggactccctagacgcgtacttctcgtcggctcccaatcgtaggggaaaccacacgcctactctcgaccatcgacggccggacccacggccgtaacggagtcggacgtcgtacgacttacgttacgtgtaccgaggcggtagggacagcacgctactagtcggttgggtttcggacgggtacgggacgaacgcgtacgtaccgttccgttcggtacgaccgccgaacggtccgtccgtcccccg

SEQ ID NO: 346975 - DNA, 704 bp, Homo sapiens
  misc_feature: GZ8MTXP02IRN2K.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcattgtccgtgtccccaggacagacagccaggatcacctgctctggagataaagttggggataaatatgcttgctggtatcagcagaggccaggccagtcccctgtactggtcatctatcaaagactaaacaacgcggcccctacgacgggactcccgtagacgcgtattctacgtcggacctccaacttccgtacggggaaaccacgacggccctactctacgaaccatacgacggacccgggacccgacgggaccgtaacggacgtacggacggtaccgtaacggtaccttaacgtttaaccgttcggtacgtaaccggggtcgggtttacgggggaaccgtacggacgaaccggtacccgtaaccgttaacgtttacgggtttacgggggtttttcccggggaaccgggggttaaaccgggggaacccgtaaacgggtcccggttaccggtaacccggtttaacccgtttcggggtacccgttaccggaccccgtaaaccgggtcccgttacccggtcccccccggg

SEQ ID NO: 346976 - DNA, 542 bp, Homo sapiens
  misc_feature: GZ8MTXP02J0OJM.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatacaagataacaagcggaccctcgagggactcctgagcgattctctcggctccaactcgtacgggaacacacgccactctacgaccatcaggccggacccgacggctacggatgagctagacttattacgtgtacgaggacgtgggacagcgagacaccgtagttcggtggtttcggggacggtacgggaccgaggccgtacggtacccgtccgttcggtccgacgacccgacggtccgtaccgtcccccgg

SEQ ID NO: 346977 - DNA, 563 bp, Homo sapiens
  misc_feature: GZ8MTXP02F2R20.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcgccctcagggactcctgacgcgattctctggctcaactctagggaacacagccactctcgacccatcaggccggaccaggctaacggatgagctagacttattactggtcgagggtccgagggacacggcgacggtaccaccgttaagtggtttacggggtttccggacggggtaaacggggaccaaacggtccgttacggaccccgtttcggttcggtaccgtacggacccgtaaacgggccctccggtaccccccgg

SEQ ID NO: 346978 - DNA, 557 bp, Homo sapiens
  misc_feature: GZ8MTXP02GU75E.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagacggccaggccagtcccctgtactggtcatctatcaagataacaagccggccctgagggactcccgtgacgcgtattctcgtcggctccaactcgtagggaaccacagccactctcgaccatcgacggccggacccaggctacggatcgaggctagtacttattacgtgtacgaggcggtagggaccagacagacctacgtagttggttcggggtttacgggcgggtaacgggaccgaacggccgtacggtacccgtcgttcggtacgacgacccgaacggcccgtccggtcccccg

SEQ ID NO: 346979 - DNA, 566 bp, Homo sapiens
  misc_feature: GZ8MTXP02HZQ2F.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacaagccgcctcgagggactcccgtgagcgtattctctcggcctccaactctacgggaaccacgacgccaactctacgaccatcgacgccgggacccagggctacggatgagggctaggacttattacgtgtacgaggacgtgggacagcgacgacctacctaggttcggttcgggttttccgggacggtaacgggacctaacggtccgttcggtaccggtccgttcggtaccgacggtacccgaacggtccgtacccggtcccccg

SEQ ID NO: 346980 - DNA, 565 bp, Homo sapiens
  misc_feature: GZ8MTXP02FFXAB.8.12.B01.1.454.CMB.2.raw
  modified_base (220)..(220): a, c, t, g, unknown or other
  misc_feature (220)..(220): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcactgctctgganataaagttggggataaatatgcttgctggtatcagcagaggccaggccagtcccctgtactggtcatctatcaagaataacaacgccggccctgagggactccctgagcgattctcgtcggctccaaactcgtagggaacacacgccaactctcgaaccatcgacgccggggacccagggaccgtaacggataggaacgggctggaacttacttacgtgttacgaggccggtaggggacaggcaggacctaccgtagtcggttgggtttcgggacgggaacgggaccgaacgccgtcggtacccgtccgttggtaccgacgcccgaacggccgtccgtcccccgg

SEQ ID NO: 346981 - DNA, 600 bp, Homo sapiens
  misc_feature: GZ8MTXP02IXVUY.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttgctggtatcagcagaggccaggccacgtcccctgtactggtcatctatacaagataacaagcgccctgacggactccctgacgcgtattctacgtcggctccaactcgtacgggaaccacacgcccactcctgaccatcgacgccgggacccagggctaacggatggacgcgtagtaactatttacgacgttcgaaggtcggtagggacgaggacgagtacctaccgttaaggttacgggtttcgggttttaccgggggacgggtaacggggaaccgtaaacgggtccgttacggtacccgttccggttacggtacgaccggaccccggtaacggtcccgttccccggtcccccgg

SEQ ID NO: 346982 - DNA, 512 bp, Homo sapiens
  misc_feature: GZ8MTXP02FK0NE.8.12.B01.1.454.CMB.2.raw
  modified_base (467)..(467): a, c, t, g, unknown or other
  misc_feature (467)..(467): n is a, c, g, or t
tcagctcgcgtgtccacgaccggtgctcgatttagtagtgtagattccgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataaacaagccggccctcgagggatcccgtgagcgattctctggctccaactctgggaacacagccactctgaccatcagccgggacccacggctacggatgaggctgactattacgtgtcaggcgtgggacagcagcactagtgtcggtttcggcggtacgggaccaacgcncggaccgtccgttacggtcgacgcccgaacggccgtcgtcccccg

SEQ ID NO: 346983 - DNA, 493 bp, Homo sapiens
  misc_feature: GZ8MTXP02FJ5NM.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgacgcgattctctggctccaactctgggaacacagccatctgaccatcacgcggacccaggctacggatgagctgactatctgtcaggcgtgggacagcagcacgtatgtggtttcggcggagggaccaaggctcgaccgtcgttcggtcacgcccaacggctcgtcccccg

SEQ ID NO: 346984 - DNA, 654 bp, Homo sapiens
  misc_feature: GZ8MTXP02G1VIG.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcgagcgaggacggccgacggccacgtccccgtgtactggtcatctatacaagaataacgaacggccggcccctacgacggggactcccgtagacgacgtattcctcgtcggtcctacccgtaactcgtacggggaaaccaccgacgaccactcctacgaacccactaccggacggacccgggaacccgacgggaccgtaacggacgtaggacggtctaggaaacttattaccgtaggtccggtaggcggtacggacgacgacgacgtaccgtaaccgttggttacggtttcggggtttccgggaacggggtaaccgggtaccgtaacggtccggttacggtacccgttccggttcggaccgaccggtacccggaacggtcccgttacccggtccccccgg

SEQ ID NO: 346985 - DNA, 626 bp, Homo sapiens
  misc_feature: GZ8MTXP02F7ADC.8.12.B01.1.454.CMB.2.raw
  modified_base (300)..(300): a, c, t, g, unknown or other
  misc_feature (300)..(300): n is a, c, g, or t
  modified_base (387)..(387): a, c, t, g, unknown or other
  misc_feature (387)..(387): n is a, c, g, or t
tcagctcgcgtgtccacgaccggtgctcgatttagtagtgtagattccgcgggggctggggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatccactgctctggagtataaagttggggaataaatatgcttgcttggtatcagcgagaggccaggccacgtcccctgtactggtcatctanacaaagaactaaacacgccggcctacgaggactcccgtgacgtcgtactttctcgtcggtctaccgtaacctcgtacggggaaaccnccacgccctaaccttcgacgaacccacggtacgacggacccggggaacccacgggtccgtaaaccgggagtacggacggttacgtacggtacttaaacgtttacgtacggtacggaggggtacccggtaggggactacggacgacgacgtacgttaggtggtttcgggtttcgggacgggaggtaccgacgacgtccgtacgtccgttggaccgacgcccaacggtccgcctcccccgg

SEQ ID NO: 346986 - DNA, 668 bp, Homo sapiens
  misc_feature: GZ8MTXP02ICP7O.8.12.B01.1.454.CMB.2.raw
  modified_base (293)..(293): a, c, t, g, unknown or other
  misc_feature (293)..(293): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgtcttgctggtatcagcagaggccagccacgtcccctgtactggtcatctancaaagataacaagcgccctcgacgggactcctgacgcgtacttctcgtcggctcccaactcgtacgggaaccaacgacgcctacctctacgacctactcgaccggacccgggacccgacgggtacgtaacgggacgttacggacggtacgttacgtaacgttaacgtttacgtacggtacgtaacgggtcgggttacggggacgaacggccgaacgtaccgtaacccgttaaggtttcgggtttacggggttttttccgggggaccggggttaaaccgggggaacccgtaaaacgggtccgttaaccggtacccggtttaacccggttacggtaccgaccggtaccccgaacgggtcccgtacccgtccccccgg

SEQ ID NO: 346987 - DNA, 544 bp, Homo sapiens
  misc_feature: GZ8MTXP02GKQ2A.8.12.B01.1.454.CMB.2.raw
  modified_base (325)..(325): a, c, t, g, unknown or other
  misc_feature (325)..(325): n is a, c, g, or t
  modified_base (398)..(398): a, c, t, g, unknown or other
  misc_feature (398)..(398): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaaagataacgaagccggccctcgaggactccngagcgattctctggctccaactctagggaacacacgccactctcgaccatcacggcgggacccaggctacggntagacggactgactagttactgtcgaggcgtgggacagcagactaccgtagttcggttacggtttcgggacgggacgggaccgaacgtccgtacgtacccgttccgtcggtaccgtacggcccgaacggccgtaccgtccccccgg

SEQ ID NO: 346988 - DNA, 550 bp, Homo sapiens
  misc_feature: GZ8MTXP02FSOK0.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggatcacctgctctggagataaagttggggataaatatgcttgctggtatcagcagaggccaggccacgtcccctgtactggtcatctatacaagataaacaagccggccctcgagggactcccgtagacgtcgtattctcgtcggctccaactcgtagggaacacacgccactctgacccatacgacggccgggacccagggctaacggataggaggctagacttacttactcggtacgagggccgtagggacaggcagctaccgtagttcggttggtttacgggacgggaacggacgaacgtcgtcgtaccgtcgtcggtacacggacccaggcctcgtcccccg

SEQ ID NO: 346989 - DNA, 571 bp, Homo sapiens
  misc_feature: GZ8MTXP02H8KHY.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagaggccaggccagtccccctgtactggtcatctatcaagataaacagcgccctcgaggactccctgagcgatttcctcgtcggcctccgaaactcgtacgggaaccacgacgcccactctacgaccctatccgaggcccgggacccgaggaccgtacgggatcggacggctacgaacttattacgtgtacgagggcgtacgggacgagcgagaccactgttacggttcgggtttcggacggggaaggaccgaacgtccgtacggtacccgttcgttcggtacaccggtacccgacggcctcccggtcccccg

SEQ ID NO: 346990 - DNA, 662 bp, Homo sapiens
  misc_feature: GZ8MTXP02G1S3J.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctggagataaagttggggaataaatatgcttgctggtatcagcaggacggccacggccacgtcccctgtacctggtcatctatacaaagataacagccgccctcgagggactccgtagacgcgtattctcgtcggcctcctaacgtcgtacgggaaccacgacgcccactctacgaccatcgaacggcccgggaacccgacggacgtaacggagtaggacgggtctacggtaaaccttacgtttaccgtacggtacggaacggggccggttacggggacacggaccgacggtacccgtaaaccgttaggtttcggggtttacggggttttaccggggacgggggaaacgggtaaacccgacggtaccgtaccggttaccccggttccgttcgggtacccgaccggaccccggtaaacggtcccccgttacccggtcccccccggg

SEQ ID NO: 346991 - DNA, 636 bp, Homo sapiens
  misc_feature: GZ8MTXP02F46K7.8.12.B01.1.454.CMB.2.raw
  modified_base (380)..(380): a, c, t, g, unknown or other
  misc_feature (380)..(380): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgagataaagttggggataaatatgcttgctggtatcagcagaggccaggccacgtcccctgtactggtcatctatacaagataacaagccggccctcgaggactcccgtgagcgattcgtctggcctccaactcgtagggaacacacgccactcacgacctancgaggccgggtacccagggacgtaacgggagttacggacggtacctaggtaaccttaagtttcgtagggttacgaacggggccggtagggggaacacggacgacgacctaccgttaagttcgggtttcgggggttttacgggaccggggtaaggggtaacccaacggggtcccgttaccggtaacccggttccgttacggggttaacccgaccggttaccccgaaacggggtccccgttaccggttccccccccgg

SEQ ID NO: 346992 - DNA, 605 bp, Homo sapiens
  misc_feature: GZ8MTXP02JZN1E.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagtggggaataaatatgcttgctggtatcagcagaggccaggccagtcccctgtactggtcatcgtaatcaaagaataaacgaaaggccggaccctacgacgggactcccgtgagcggtactttccgtcgtcggcctccctaaacgtcgtacgggaaaccacgacgccaacctctacgacccataccgacggcccgggacccagggacctacgggatcggaacggctagaccttaagttactggtacgaggcgtagggaccaaggcaaggcctaaacgtgttagggttcggggtttacgggcgggtaacgggaccaacggtccgtacgtaacccgttcgttacggccgacgtacccgaacggtcccgtcggtccccccgg

SEQ ID NO: 346993 - DNA, 632 bp, Homo sapiens
  misc_feature: GZ8MTXP02I4R9N.8.12.B01.1.454.CMB.2.raw
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (405)..(405): a, c, t, g, unknown or other
  misc_feature (405)..(405): n is a, c, g, or t
tcagctcgcgtgtccacgaccggtgctcgatttagtagtgtagattccgcggggctgggcctcaggaagcagcatcggaggtgcctcagccatggcatggatccctctcttcttcggcgtccttgcttactgcacaggatccgtggcctcctatgagctgactcagccaccctcagtgtccgtgtccccaggacagacagccaggatcacctgctctggagataaagttggggaataaatatgcttgctggtatcgagcaggacggccgacggccacgtccccctgtactggtcatctananaagataacagccggccctacgacggactcccgtagacgcgtacttctcgtcggcctcccgaaacgtcgtacgggaaccacaacgcccactctacgaccctacncgacggccggggacccacggacgtacggatcggagcgtacgtaacttacgttaacgtcggtacggacgggtcggtacggggacacggacgacgtaccgtaccgttaggtttcggggtttcggggttttccggggacggggtaacgggaaccgtaacgggtccgtaccggtacccggttcggttacggtaccgacggtacccgaacgggtccctaccggttcccccgg

SEQ ID NO: 346994 - DNA, 521 bp, Homo sapiens
  misc_feature: GZ8MTXP02G7U2S.8.12.B01.1.454.CMB.2.raw
  modified_base (310)..(310): a, c, t, g, unknown or other
  misc_feature (310)..(310): n is a, c, g, or t
  modified_base (495)..(495): a, c, t, g, unknown or other
  misc_feature (495)..(495): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacagcgcctanaggactcctgagcgtattctcgtggcctccaactcgtagggaaaccacacgccactactcgaacccatacgaggcccgggacccaggcctaacggagtgaacggctagacttattacgtgtcgagggcgtgggacagcagcactagtgtcggtttcggcggacggtacaacgcgtcgacgttcgnggtacacgccgacggccgtcgccccg

SEQ ID NO: 346995 - DNA, 676 bp, Homo sapiens
  misc_feature: GZ8MTXP02G3PDX.8.12.B01.1.454.CMB.2.raw
  modified_base (399)..(399): a, c, t, g, unknown or other
  misc_feature (399)..(399): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcactgctctggagataagttggggataaatatagcttgctggtatcagcagaggccaggccagtcccctgtactggtcatctatcaagataacaagcgccctgacgggactccctgacgacgtacgttctcgtcggctcccaaactccgtacggggaaaccaccgacgaccctacgtacctacgaaccctanaccgacggcccgggaacccgagggaccgtaaccggtacgtagggacggtactacgggtaaacccttagtttaaccgtcggttaccggtaagggcccgggttaaggggacgacggaccgaacgtaccgtaaaccgtttaggttacggtttcgggggtttttacgggaccgggggttaaaccggggtaccgaaacgggtcccgtaacggttaccccggttccgttttacggacccgtacggaccccgaaccggggttcccgtaacccggttccccccgg

SEQ ID NO: 346996 - DNA, 594 bp, Homo sapiens
  misc_feature: GZ8MTXP02FISHA.8.12.B01.1.454.CMB.2.raw
  modified_base (373)..(373): a, c, t, g, unknown or other
  misc_feature (373)..(373): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccagtcccctgtactggtcatctatcaagataaacgaagccggaccccttcgaggggactcccgtgacgtcgaattcctctggcttccaaactctacggggaaaccncgacgcccactacctcgacccatacaggacccgggacccagggaccgtaccggatcggagtcgtagacttagttactgttacgaggtacggtcgggacacggacagaccgtacctaagtcggttacgggttttcgggacgggtaacgggtaccgaaacggtccgtacgtaaccggtccgttcggttaccgacggcccgtaaaggcccgtccgtccccccgg

SEQ ID NO: 346997 - DNA, 511 bp, Homo sapiens
  misc_feature: GZ8MTXP02GGNRE.8.12.B01.1.454.CMB.2.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaggacagacagccaggatcacctgctctggagataaattggggataaatatgcttgctggatcagcagaggccaggccagtcccctgtactggtcatctancaagataacaagcggccctnagggatcctgancgatctctggctccaactctggacnancactcgnaccctancagcggacccaggtctacgggatgagngtnactntatgtcgagcgngggacgagcagaaccgtagtggttcggtttcgggcgggacgggacgaaacgcgtacgtccgtcgttcggtcgacgaccgaacggcgtccgccccgttccccgg

SEQ ID NO: 346998 - DNA, 591 bp, Homo sapiens
  misc_feature: GZ8MTXP02IYHFQ.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccacgtcccctgtactggtcatctatacaagataaacagcgcctcgagggactccctgacgcgtattctctcggctccaactcgtagggaaccacagccaactctcgaccactcgaacggcccgggacccagggactacgggatacggacgggtctacgtaccttaagttacgtcgtacggaggtccggtagggacaggaccaggcctaaaccgtgttacgggtttgggtttaccgggcggggaaacgggtaaccaacggtcgtacggtaacccgttccgtttcggactaccggaccccgtaagggtcccgtaccgtccccccgg

SEQ ID NO: 346999 - DNA, 711 bp, Homo sapiens
  misc_feature: GZ8MTXP02FQFRC.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtcccctgtactggtcatctatacaaagataaacaagccggccctacgagggtactcccgtgacgtcgtattcgtcgtcggcctccaacgtcgtacgggaaaccacgacgaccctactctacgaaccctagtaccgaacggacccggggaccccgacggggtaccgttaacggggacgtacgggacggtaccgttacggtaaaccttaacgtttaacgttacggttaccggaaggggtaccgggttacgggggaaccgaaggaccgtaacgggaccctaacccgttaaggtttacggggttttccgggggttttaacgggggacccgggggtaaacggggtaaacccgaaacggtccggttaccggtaacccggttcccggtttacgggtaccgtaacccggacccggtaaacgggtcccgttacccggttcccccccgg

SEQ ID NO: 347000 - DNA, 559 bp, Homo sapiens
  misc_feature: GZ8MTXP02JHK58.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggatcacctgctctggagataaagttggggataaatatgcttgctggtatcagcagaggccaggccagtcccctgtactggtcatctatcaagataaacgaagcggccctgagggactccctgacgcgtatttctcgtcggcctcctaaactcgtagggaaccacgacgccaactctacgacccatacgacggtacccggggacccacgggcgtacgggatcggacggctaggacttacgttacgtgtcgaggcggtgggacagcgagacctacgtagtcggttcggtttcgggcggacgggaccgacgcgtcgaccgtccgtggtaccgacgaccgacggtccgtccgtcccccg

SEQ ID NO: 347001 - DNA, 614 bp, Homo sapiens
  misc_feature: GZ8MTXP02J0213.8.12.B01.1.454.CMB.2.raw
  modified_base (221)..(221): a, c, t, g, unknown or other
  misc_feature (221)..(221): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataaattggggataaatatgcttgctggtatcagcagaggccaggccagtccccctgtactggtcatctatcaagataacaagccggcctcgagggactcccgtgacgcagttctcgtggctccaaactcgttaggggaacacaacgcccactcctagacccatcacggccgggacccaggccgtaacggtagtcgaacggctagtaactacgttacgtggtcgaacgggtcggtacgggacacggcgacgaccgtaacgtacgttcgggttagggtttccgggcggggtaaacgggacccgtaaaggccgttacgggtaaccccggttccgtttacggggtaccgtaaccgggacccccgtaaaggtcccggttacccgttcccccccgggg

SEQ ID NO: 347002 - DNA, 670 bp, Homo sapiens
  misc_feature: GZ8MTXP02IL7QD.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctaggagtaataaagttggggaataaatatagtcttgcttggtatcagcgagacggccgaggccacgtccccctgtactggtacatctaatacaagactaaacagccggaccctacgaggtacgtccctagacgtaccgtacttctcgtcggctcccgtaactcgtacggaacaccgacgaccctactctcgaccagtacgacggacccgggtaccagggaccgtacggagtacggacgtcgtacgttaacttacgtttacgtacggttcgaacgggtcggttacggacgaacgccgaacgtaccgaaccgtttaggttcggtttacgggggttttaccgggacgggtaaaccggggaaaccctacggtacccgtaacgggtaccccgtttccggttacggacccgtaaccggtacccgtaaccgggtcccgttaccccggttacccccccggg

SEQ ID NO: 347003 - DNA, 617 bp, Homo sapiens
  misc_feature: GZ8MTXP02G8HI6.8.12.B01.1.454.CMB.2.raw
  modified_base (462)..(462): a, c, t, g, unknown or other
  misc_feature (462)..(462): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagacggccacggccgacgtccccgtgtactcggtcatactatacaaacgaataacgaaacgccggtcccgtacgaacgggtactccgtacgacgcgtacttcgtcgtcggtacctacccaacgttacgtaacgggaaccactacgacctacctcctacgaaccactacggaccggcccgggaacccgtaggaccgtaacgggangggacgctacgtaacttacgttacgtggtcggaacggtcggacggggaccaggacccgacggtactaccgtaggtttgggtttacgggtttgggacggaacggtacgacgacgtcgtaccgtcgtacgcgacgccacgggtcctcccgtccccgg

SEQ ID NO: 347004 - DNA, 645 bp, Homo sapiens
  misc_feature: GZ8MTXP02HDFHL.8.12.B01.1.454.CMB.2.raw
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
  modified_base (526)..(526): a, c, t, g, unknown or other
  misc_feature (526)..(526): n is a, c, g, or t
tcagctcgcgtgtccacgaccggtgctcgatttagtagtgtagattccgcggggctgggcctcaggaaacagcatcggaggtgcctcagccatggcatggatccctctcttcctcggcgtccttgcttactgcacaggatccgtggcctcctatgagctgactcacgccaccctcagtgtccgtcgtccccaggacagacagccaggatcactgctcnggagtaataaagttggggaataaatatgtcttgcgtggtancgagcgaggacgccaggccacgtccctgtactgtctatctatacaagaataaacgacgtcccggcctacgagggtacctccgtagaccgtcgtacttccgtcgtcggacctaccgtacgtcgtaacgggaaaccaccgaccgtacctacttaccgaaccgtacctacgaccggaccggggtaccggtaacccgaggtaccggtaacggtacgagggacgtacgtactaacgtttacttacgttcggacgtaggggacggtacggacncggacgacgtcgttaacgttggttccgggttacgggtaccgggagggtaacggactacggtcgtaccgccgttacggtcgaccgaccggtaccgacgtccgtccccgtaccgttcccgg

SEQ ID NO: 347005 - DNA, 650 bp, Homo sapiens
  misc_feature: GZ8MTXP02H300X.8.12.B01.1.454.CMB.2.raw
  modified_base (175)..(175): a, c, t, g, unknown or other
  misc_feature (175)..(175): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccaggatcactgctctggagataaagttggggaataaatatgctgctggtatcagcaggacggccaggccacgtcccctgtactggtcatctatacaaagaataaacgaacggccggaccctacgaacggggtactcccgtaggacgtccgtacttcgtcgtcggcctaccaacgtcgtacggaaaccacacgaccactcctacgaccactcgaacgggcccggaacccgagggaccgtaacgggagttcggaacggtcgtaaggtaactttaacgtttaccgtaggttacccggaggggttacggtaacggggaacacggcgaacgtaccgtaccttaaggtttcgggttacgggttttccggggacggtaacggggaacctaacggtccgtcgtaacccggttcgttcggtaccgacggacccgacggtccgttcccggtcccccgg

SEQ ID NO: 347006 - DNA, 669 bp, Homo sapiens
  misc_feature: GZ8MTXP02GMLBU.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagacggccacggccacgtccccctgtactggtcatctatcaagataacaagccgccctgaggactccgtgacgcgtattctctcggctccaactcgtacggaacacgacgccactcgtagacccatcgacggcccggacccgacgggacgtaacggagtacggacggtactacggtaacttaacgtttaaccgtcggtaccggtaacgggccgggttacgggaacgacggaccgaacgtacccgtaaaccgttacggtttcggggtttacggggtttttaccgggggaccggggttaaccgggggaacccgtaacgggtacccgttcgggttaaccccggttccgtttaccggggtaccgtaacccgggacccccgtaaacggggtccccgttacccggttccccccccgg

SEQ ID NO: 347007 - DNA, 611 bp, Homo sapiens
  misc_feature: GZ8MTXP02JTERS.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggactcacctgctcgtggagataagtgggaataatatgctgctgtatcagcaggacgccaggccacgtcccctgtactggtctatctatacaaagaactaacgaacgccggtaccctagacgggctccgtgacgacgtacttccgtcgtcggcctccgtaactcgtacggaaccacacaccgtacctctacgacctacgacgacggaccgggacccgacggacgtaacggagtacggacggtaccttaggtaacctttacgttacgtcgtaccgggtaaggcgggtacggacgagaccgtacgacgtaccgtaggttcgggttcgggtttacgggacgggtacggacgtaacgtccgtcggtacggtcgttacggacgtacggacccgtacggccgtccgtcccccgg

SEQ ID NO: 347008 - DNA, 572 bp, Homo sapiens
  misc_feature: GZ8MTXP02G3MJX.8.12.B01.1.454.CMB.2.raw
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgctgctggtatcagcagaggccaggccacggtcccctgtactggtcatctatcaagaataacagcggccctagagggactcccgtgacgcgtattctcgtggcctccctaacgtcgtacgggaaaccacacgccactctagacccatcgacgccgggaccnggctaggntagngctgactattcgngtcgaggcggtaggacagtcgaacgtcgtacttagttacgggtttcggtttaccggggacgggtaacggacccgaacggtccgttcggtaccccggttcgttcggtaccacgggacccgtacggtcccgtaccggttccccccgg

SEQ ID NO: 347009 - DNA, 542 bp, Homo sapiens
  misc_feature: GZ8MTXP02GP0X8.8.12.B01.1.454.CMB.2.raw
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (441)..(441): a, c, t, g, unknown or other
  misc_feature (441)..(441): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttgctggtatcagcagacgcaggccagtcccctgtactggtcatctatcaagataacagcgcccanagggactcctagagctacgttctcgtggctccaactcgtacgggaacacagaccacttcncgaccatcgacggccggaacccngggcctaaggacagacggctgtaacctattacgtgtacggagggtaccgnggggacaggcgaggactaccgtatggttgggtttcggacggggacggtacgacgtcgtacgtccgtcgtcgggtacacgacccgaacggcctccgtccccg

SEQ ID NO: 347010 - DNA, 702 bp, Homo sapiens
  misc_feature: GZ8MTXP02IQQIK.8.12.B01.1.454.CMB.2.raw
  modified_base (280)..(280): a, c, t, g, unknown or other
  misc_feature (280)..(280): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtcccccaggacagacagccaggatccacctgctctggagataaagttggggataaatatgcttgctggtatcagcagagccaggccacgtccccngtactggtcatctatcaaagataaacagaccggcccctacgaggactccgtgagtcgtattctcgtcgcctccactcgtagggaccacaacgccaactctacgacccatcgacggccggggacccgacgaccgttacgggactagggacggtaccgttaggaaacctttacgtttaaccgtcgggtaccggttaaagggggcccggttacggggaaacgtcgggacaaccgtttaaccaccccgttttaaaggtttcgggggtttttaaacggggtttttcgggggacccgggggtttaaaacggggaaacccgttaacgggtccgtttaaacccgggttaccccggtttccgttttaacggggcccgttaaaccggaccccggtaaaccgggtcccgtacccccggtttaccccccccggg

SEQ ID NO: 347011 - DNA, 642 bp, Homo sapiens
  misc_feature: GZ8MTXP02JFYSS.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagagccaggccagtcccctgtactggtcatctatcaaagataacaagccggccctcgaggggactccctagacgcgtattctcgtggcctccaaacttcgtaggggaaaccacacgcccactctcgaccatcgacggcccggggacccacgggaccgtaaccgggatcgggaaggtcgtacgtaacgttactttaccgtggttcgacggggacggtgggggaacaggcaacggtaccgtaacctaggtttcggttacggggttttaccggggacgggaacggggaaccgtaaacgggtcccggttacggtaacccccggtttccgttcggggttacccaccggggtaccccgtaaaccggggtcccgtccccggttcccccccgg

SEQ ID NO: 347012 - DNA, 612 bp, Homo sapiens
  misc_feature: GZ8MTXP02I8QJY.8.12.B01.1.454.CMB.2.raw
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (600)..(600): a, c, t, g, unknown or other
  misc_feature (600)..(600): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcgtggagataaagttggggataaatatgcttgctgtatcagnagacggcacggccacgtcccctgtactggtcatctatacaagataacgagcgccncgacgggactccgngacgngtacttctctcggctccaactcgtacggaacacncgaccactctacgacctancgacggcccgggacccagggtaccgtaacgggaagttcggaggtaccgtagtaaaccgtttacgttacgtacggtacgggaacggggtcccggtaggggaactacggactaaccttacgtacctaggtttcgggtttacggggtttcggacggggacgggaacaacggtccttacggtacccgttccgtacggtaccacggtacccgacggtcccnccggttcccccg

SEQ ID NO: 347013 - DNA, 551 bp, Homo sapiens
  misc_feature: GZ8MTXP02IXHW4.8.12.B01.1.454.CMB.2.raw
  modified_base (321)..(321): a, c, t, g, unknown or other
  misc_feature (321)..(321): n is a, c, g, or t
  modified_base (389)..(389): a, c, t, g, unknown or other
  misc_feature (389)..(389): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagataacagcgccctgaggatcctagngcgattctctcggctccgactcgtacggaaccacacgccactctacgaccatcgacggccgggacccncgggactacggatgaggctagactattactggtcgagggcgtggacngacgngactacgtattcggttcgggtttcgggacgggtaacggggacctaacggtccgtacggtacccgtcgttcgggtacacggtacccgaacggtccgtaccggttcccccgg

SEQ ID NO: 347014 - DNA, 524 bp, Homo sapiens
  misc_feature: GZ8MTXP02FOV2E.8.12.B01.1.454.CMB.2.raw
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataaacaagcggcctcagggatccctgagcgattcnctggctccaaactctgggaacacagccactctgaccatcgagcgggacccaggctacggatgagcgngatagtaactgtcagcgtggacgagcagcgacctagtcggtgggttttcgggacgggtaggggacgaacggcgtacggtaccgtccgttacggttaccgacggcccgaacggtcgtcgtccccccg

SEQ ID NO: 347015 - DNA, 630 bp, Homo sapiens
  misc_feature: GZ8MTXP02F87NL.8.12.B01.1.454.CMB.2.raw
  modified_base (220)..(220): a, c, t, g, unknown or other
  misc_feature (220)..(220): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcactgctctgganataaagttggggaataaatatgcttgctggtatcagcagaggccaggccacgtccctgtactggtcatctanacaanataaacacgccggccctgaggactccgtgagtcgtattcgtcgtcggacctccgtaactcggtagggaaaccactacgcctacttcacgacccatacgacggcccgggaacccacgggtaccaacggggataggacggtacgtcggtaaacttacgtttaccgtgttacggaggggtccgtaagggacgacgacgaacgaccgtaacgttagttcgggtttacgggtttaccggggacggggtaaacgggaaacccgtaaggtccgttacccggtaaccgttcccggttacggtaaccgaccgtacccgtaggtccccgccgttaccccccgg

SEQ ID NO: 347016 - DNA, 670 bp, Homo sapiens
  misc_feature: GZ8MTXP02FQL4K.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccaggactccactgctctggagaagtaaagttggggaataaatatgacttgcgttaggtatcgagacgaggacggccaggccctacgtccccgtgtactggtcatctatacaagataacgacgccgccctacgaggtactcccgtgacgctattcctcgtcggtcctccacctcgtacggaacctcgaacgccactcgtacgaacctagaccgacggacccggaaccgacgggtaccgttaacggacgtacggacggtacgtacggtaaacttacgttacgtcgtacgggacgggttacggacggaacgacggtcgaacggtaccgtaccgtttaaggttcggggtttacggggtttaccgggggacgggaaacgggtaccggtaacggtacgtacccggttaacccgtcggtttcggaacccggtaccgacccggtaaaccgggtccctacccgggttccccccgg

SEQ ID NO: 347017 - DNA, 662 bp, Homo sapiens
  misc_feature: GZ8MTXP02GM8H2.8.12.B01.1.454.CMB.2.raw
  modified_base (294)..(294): a, c, t, g, unknown or other
  misc_feature (294)..(294): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccaggatcactgctctggagataagttggggataaatatgcttgctggtatcagcaggagccaggccagtcccctgtactggtccatctatnaaagataactaacggccgccctacgaggactccgtgacgcgtattctcgtgcctccactcgtaggaaccacacgccaactccgtacgaacctagtccgacgggcccggggaaaccctggggaacctaacggggagtaccgggaggtccgtagttaacgttaacgtttacgtcggtaccgggtacggggaaccggtggggaacacgggacgtacggtaccgtaaaccgtttggttaacggggtttcggggttttaccgggggaccgggtaaccggggaacctaacgggtaccgttaccggtaacccgtttccggtttacggtaccgaccgggacccccgttaaggccccgtttacccggtccccccggg

SEQ ID NO: 347018 - DNA, 655 bp, Homo sapiens
  misc_feature: GZ8MTXP02H67FH.8.12.B01.1.454.CMB.2.raw
  modified_base (175)..(175): a, c, t, g, unknown or other
  misc_feature (175)..(175): n is a, c, g, or t
  modified_base (245)..(245): a, c, t, g, unknown or other
  misc_feature (245)..(245): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctnagtgtccgtcgtccccgagacagacagccaggatcacctgctcgtggagataaagtggggaataaatagngtcttgcttggatcgagcaggcgaccgagccacgtcccctgtacgtggtcatcgtatacgaaagaataaacaacggccgacctacgacgggactccgtgagtccgtactcgtcgttacggacctaccaacgtcgtacggaaaccacgaccgaccactcccgacgacctaacgtaccgacgggacccggaaccccgtaggtaccggtaacggacgttagggacgtacgtacgtaacttagtttaccgtgaacggcgggttagaacggacgacgacgtacgacgtacgtaggttcgggttaacgggtttcggggacgggaaaacgggtccgaaacgggtccgttaccggtacccggtttcggttaccgaccggttaaccggaccgtaacggccccggtttacccgcccccgg

SEQ ID NO: 347019 - DNA, 665 bp, Homo sapiens
  misc_feature: GZ8MTXP02IXYUW.8.12.B01.1.454.CMB.2.raw
  modified_base (248)..(248): a, c, t, g, unknown or other
  misc_feature (248)..(248): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcacctgctctggagataagtgggataatatgctgctgtancagcagcgccgagccacgtcccctgtactggtcactctatacgaaagaataaacaacggccgaccctacgacgggtactcccgaggacgtcgtacttcctagtccggacctaccgtacgtccgtaacgggaaaccacgacgccctaacgttcacgaaccacgtacgacggacccgggaacccgacggtacgtaacggtagacggacgtacgtacgttaacttaagtttacgtacgttacggacgggtaccggtacggaacgacgacgacgtacgtaccgttaggtttcgggttcggggtttaccggggaacggggttaacggaaccgtaacgggttccgtaccgggttacccggttccggttacgggttaccgtaaccccgggtacggaacccggtcccgtacccggttccccccgg

SEQ ID NO: 347020 - DNA, 586 bp, Homo sapiens
  misc_feature: GZ8MTXP02HDX1G.8.12.B01.1.454.CMB.2.raw
  modified_base (220)..(220): a, c, t, g, unknown or other
  misc_feature (220)..(220): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctcgnggagaataaagttggggaataaagtatgtcttgctggtatcagcagacggcacggccacgtccccgtgtacctggtacagtctatacaaagaactaaacgaaggccgaccctcgacggactccgtagagtacgtacttctcgtcggcctaccgtaactcgtacgggaaccaccgacgcccactctacgaaccacgtacgacggaccggacccgcggacgtacgagtagacgcttcgatacttagcgtcggaggtcggaggacgacgacgacgtactacgtacggttcggttacgggtttcggacgggtacggacgacgcgtaccgcgttccgtggtaccgacggtaccgacgtccgtccgtccccg

SEQ ID NO: 347021 - DNA, 640 bp, Homo sapiens
  misc_feature: GZ8MTXP02HF8P2.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctgagataaagtggggaataatatgtcttgctggtatcgagcagaggccaggccacgtcccctgtactggtctagtcctaatcaaagtaactaaacgaacggccggccctacgacgggactcctagacgcgtattcctcgtcggcctccaaccgtcgtacggaaaccacacgaccaccgtactcgaccaacgtcgaacggacccgggacccgacgggtaccgtaacgggatacgggacggacgttacgtaacgttactttacgtacggttcggacgggtacgggtagggacgagaccgacggacctaccgtaggttacggttcggggttttacgggacggggacgggtaaccgaacggtccggtacgtacccggttcgttacggtaccgaccggaccgtaaccggccgtacccggtcccccgg

SEQ ID NO: 347022 - DNA, 597 bp, Homo sapiens
  misc_feature: GZ8MTXP02FXGUA.8.12.B01.1.454.CMB.2.raw
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcattgtccgtgtccccaggacagacagccaggatccactgctcgtggagataaagttggggaataaatatgacttgctggtatcagcagaggccaggccacgtcccctgtactggtcatctatacaagataaacgacgccggccctacgaggactccgtgagctatctactgcctaccactcgaacggaacacgacgccactcgtacacctanacgacggccggaccaggaccgaggancggacggctagaacttattacgtgtaccggaggtaccggaggaccgaggctacggactaccgttagttgggtttcgggtttacggggacgggtaaacggaccgtaaacgtccgtaccggttaacccggttccgtttcgggaccgtaccggacccgaaccggtcccgtaaccccggggttcccccg

SEQ ID NO: 347023 - DNA, 642 bp, Homo sapiens
  misc_feature: GZ8MTXP02FP6OA.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggaataaatatgcttgctggtatcagcagaggccaggccagtcccctgtactggtcagtctatacaagataaacgaagcggccctacgagggactccctgacgctagttctctcggacttccaactcgtacggaacacgacgccactctcgaccatcgacggccgggacccgacggaccgtaacgggacgtacggaaggtccgttagaaaccgttaacttacgtaggttacgaaggggtacccggttagggggaaccacgggtacccaagggaccctaaaccgttaacgttgggttaccggggtttttccggggacggggtaaacggggaacccgaaacggtccgtacggtacccgtccggtttacggtaccgaacgtccccgaaacgggtcccgttcccggtacccccgg

SEQ ID NO: 347024 - DNA, 552 bp, Homo sapiens
  misc_feature: GZ8MTXP02F5G13.8.12.B01.1.454.CMB.2.raw
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtcccctgtactggtcatctatcaagataacaagcggaccctcgaggactcctagacgcgattctctcggctccgaactcgtacgggaacacgagccactctgacccatcgacggccgggacccaggctaaccggatacgaggtctagacttattacgngtacgaggtcgtgggacngacagctaactgtcggttacggtttcggacggtacgggacctaacggctacggtaacccgttcgttacggacacggacccgtaacggtccgtaccgtcccccgg

SEQ ID NO: 347025 - DNA, 610 bp, Homo sapiens
  misc_feature: GZ8MTXP02HRYLB.8.12.B01.1.454.CMB.2.raw
  modified_base (343)..(343): a, c, t, g, unknown or other
  misc_feature (343)..(343): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctggagataaagttggggataaatatgtctgctggtatcagcagacggccaggcccacgtcccctgtactggtcatctatacaagataacaagccgaccctcgagggactccgtagagcgtattctntcggctccacttcgagggaaccacgacgccactctacgaccatccgaggacccgggacccgacgggacgtaacgggatacgggacggtcctaggtacttaacgtttacgtggttacggaagggtcggtagggacacggacactaccgtacgttacgttcggtttcggggttttcggggaccgggtaacgggtaccgaaacggtccgtaccggtaccgttccggtcggtaccgtaccggacccgtacggtccgttcccgtccccccgg

SEQ ID NO: 347026 - DNA, 722 bp, Homo sapiens
  misc_feature: GZ8MTXP02GOX4M.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcgtggagataaagttggggataaatatgtcttgcgtggtatcagcagacggcacggccacgtcccctgtactggtcactctatacgaagtaactaaacgaaggccggacccgtcgaggggtaacctcccgtaggacgtacgtacttactcgtcggcctacccaacgttcgtacgggaaaccacgacgaccctacgtactcgtaccacgtacgacggacccggacccgagggtacctaaacgggatacggacggaccgtacgtaaccgtttaattaccggttagggtaccggtagggaccggggttacggaacgacggtacgaaccgggaccttaacccgttaaggtttcggggtttacggggttttacccgggggaccggggttaaaacgggggaacccctaaggggtacccgttaccgggtaccccgggttaacccggtttaccggggttaccgtacccgggtaacccggaaaccgggtcccggtttaacccccggtaccccccgg

SEQ ID NO: 347027 - DNA, 703 bp, Homo sapiens
  misc_feature: GZ8MTXP02HNC7H.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatcacctgctcgtggagaataaagttggggaataaatatgtcttgctggtatcgagcaggacggccaggccacgtcccctgtactggtcatctatacaagataacagccgaccctacgaggtactccgtagacgacgtattctcgtcggctcctaacgtcgtacgggaacccacgaccacctactacctacgaccctacgtaccgacgggacccgggaacccgacgggtaccgtaacgggtacgtacggacggtacgttacggtaacctttaacgtttaccgtacggttacgggaacgggtacgggtacggggaaccgaacgggtacgaacgggtacctaaccgttaacggtttcggggtttaccggggtttttacggggaaccgggggttaaacggggaacccgtaaacgggtccgttaaccgggtacccggttccggtttacggtaacccgtaccgggacccgtaacgggtccccgttacccggtccccccgg

SEQ ID NO: 347028 - DNA, 704 bp, Homo sapiens
  misc_feature: GZ8MTXP02G8R1F.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggatcacctgctctggagaataaagttggggaataaatatgtcttgctggtatcgagcgagacggccaggcccacgtccccctgtacgtggtctatctaatacaaagaactaaaacgacggccgacccctacgaacgggacctcccgtaggacgaccgtatttccgtcgtcggtaccctcccgtaaaccgttccgaacggggaaaccaccgacgccctaaccttcgaccgacctaacgccggaacgggacccgggaaacccgtacggggacccgttaacgggacgttacgggaacggtccgttaacgtaaaccgtttacgtttaacgtagttaccgggacgggtaccggttacgggacgacgacgtacgacccgtaacgttacggttggtttaccggggttttcggggacgggtaacgggaacccgtacggaccgttaccgtaacccgttccggttacgtacccggacgacccgaacggtccccgtaccgttccccccgg

SEQ ID NO: 347029 - DNA, 657 bp, Homo sapiens
  misc_feature: GZ8MTXP02JW3SX.8.12.B01.1.454.CMB.2.raw
  modified_base (310)..(310): a, c, t, g, unknown or other
  misc_feature (310)..(310): n is a, c, g, or t
  modified_base (524)..(524): a, c, t, g, unknown or other
  misc_feature (524)..(524): n is a, c, g, or t
tcagctcgcgtgtccacgaccggtgctcgatttagtagtgtagattccgcggggccgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacacgccaggatcacctcgctcgtggagaataaaggttagggggaataaatatgcttgcgtggtatcgagcaggacggccgacggccacgtcccctgtacgtggtcatctanacaaagtataaacgacgccggcctacgaggactcccgtagacgtacgtattctcgtcggcctaccactcgtacgggacaacgacgacccacttaccacgacccaacgttcggaacgggcccggggaaaccccgtagggacccgtaacgggagtacggacgcgttaaacggactttacgtacgtcgtaggacgggtcggacggacgacgacgganacccgtacgttaggtcgggttttcggggtttacgggacgggggtacgaacccggtaacgtccggtacgttaccccggttcgttaaccggtcgaacccggtaccgtacgggtccctcccggtcccccgtaccgg

SEQ ID NO: 347030 - DNA, 694 bp, Homo sapiens
  misc_feature: GZ8MTXP02GHCMB.8.12.B01.1.454.CMB.2.raw
  modified_base (223)..(223): a, c, t, g, unknown or other
  misc_feature (223)..(223): n is a, c, g, or t
tcagctcgcgtgtccacgaccggtgctcgatttagtagtgtagattccgcgggggctggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataaagttggggataaatatgcttgctggtatcagcagaggccaggccacgtcccctgtactggtcatctaatcaagataacgacgcggccctcgagggtactccgtagagcgtattccgtctcggtacctccgaaactcgtaagggaaccacgtaacgcccaactcctagacccacgcgaacggaccgggaaccccagggtaccgtaacggacgttacggaggtacgttaacggtaacttaacgtttaccgtacggttaccggaaggggttcggtacgggggaactacggggaacaacgggtaccttaacccgttaaggtttccggggtttaacggggtttttcccgggggacggggtaaaccggggtaaaccgaacggggtcccgttacgggttaaccccgttccggtttccgggaaccgttaacccggaccccgaaacggggttccccttacccgggttcccccccgg

SEQ ID NO: 347031 - DNA, 700 bp, Homo sapiens
  misc_feature: GZ8MTXP02HTYE2.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccaggatcacctgctctggagataaagttggggaataaatatgtcttgcgttggtatcgagacgaggacgccgacggccacgtccccgtgtactggtacatactatacaaagtaactaaacgaacggccggaccctcgtaacggggacttaccccgaggacggtccgtaagttccgttcgtccggtacctacccgtaacgtccgtaaggggaaaccctaccgaacggtaccctaaccgtctacgaaccctagtacccgaacgggcccggggtaaacccgacgggtaaccgtacgggaacgtacgggaacgtacgttaacgtaactttaacgtttaccgtggtaacgggcgggtacgggttacgggggaacacggccgtaacgtaccgtaaacccgtttgggttaccgggtttacgggggtttacgggacgggtaaccggtaacgacgcgttccggaacgttccgtacgtaccgacggccgaccggtctcccgtcccg

SEQ ID NO: 347032 - DNA, 595 bp, Homo sapiens
  misc_feature: GZ8MTXP02F6C0A.8.12.B01.1.454.CMB.2.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
  modified_base (477)..(477): a, c, t, g, unknown or other
  misc_feature (477)..(477): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcacctgctcngganaataaagttggggaataaatatgcttgctggtatcagcgagacggccaacggccacgtcccctgtactgctatctatacaanaactaaacgaacgccggtaccctacgacgggactaccgngacgtacgtagttctcncggtcctcctactcgtacggaacncacgccactctacacacacgacggccggaccgacggcgtaacgggataggcgacgtagtaacttagtacgtggtacgagggtcgaggagacgngacgactacgttaagttcggtttcggggtttacggggacggaacgggaaccgacggtccgtacggaccggtttcgttcgggactaccggacccaacggggtccctacccggtcccccg

SEQ ID NO: 347033 - DNA, 668 bp, Homo sapiens
  misc_feature: GZ8MTXP02F9T66.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacacgccaggactccacctgctcgtggagataaagttaggggaataaatatgcttgctggtatcagcaggacggccgacggcccacgtcccctgtacgtggtctatctatacaaagaactaacgacggccggtccctacgacggtacttacctacgacgtacttcgtcgtcggccctaccacgtcgtacgggaaaccaccgacgacctactcctacgaccctacgtacgaccggccgggaacccgaggacccgtaggacgtggacgtctaaggtacttagttacgtcgtacggacgggtcgacggggacacgacgtaaacgtctaaacccgttgggttcgggttggggtttacccggggacgggacggtaaaccgaacggttcccgtacgggtaccccgtttaacggtccggtacgtaacccggaccccggtaggttcccccgtaccccgggttacccccgtttaccgg

SEQ ID NO: 347034 - DNA, 635 bp, Homo sapiens
  misc_feature: GZ8MTXP02GMZ1F.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccacgtcccctgtactggtcatctatacaagaataacaagccggtccctacgaacggggactcccgtcgacgcgtattcctcgtcggcctccgaactcgtacgggaacacgacgccacctctcgaacccactaccgacggacccggggaaccccgacgggacgttaaccggggagtacggacggtacctacggtaaacttacgtttaacgtcgtaccgggaggaccgggtaggacgagaccgagtaccgaccgttagttacggtttcggggttttaccgggacggggttaaacgggaccgaacggtaccgtacggtacccgtccggttacggacgaccgacccggtaacggccgttcccgtcccccgg

SEQ ID NO: 347035 - DNA, 637 bp, Homo sapiens
  misc_feature: GZ8MTXP02F5TO8.8.12.B01.1.454.CMB.2.raw
  modified_base (409)..(409): a, c, t, g, unknown or other
  misc_feature (409)..(409): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtacatctatacaagactaacaacgccgccctagagggactcccgtagacgcgtattctctcggcctccaactcgtacgggaacaccacgcccactcgtacgaccatacgacggcccgggaacccnggacctacgggagtaggacggactacggaacttacgttacgtgttacggagggacccgtaggggacctacgggacaacgtaccgtaccgttaacgttcgggtttacgggttttaccgggacgggggttaacgggaacccgtaaacggtccgtaccggtaacccgttccggtttacgggtaccgacccggaccccggtaaacggtcccgtaccccggttcccccccggg

SEQ ID NO: 347036 - DNA, 627 bp, Homo sapiens
  misc_feature: GZ8MTXP02F1AYV.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccaggatcactgctctggagataaagttggggataaatatgcttgctggtatcagcaggagccaggccacgtcccctgtactggtcatctatacaagataaacaagccggaccctacgaggactcccgtagacgcgtattctctcgtctccaactcgtaacgggaaaccacgaacgaccctactcgacgacccactacgacggacccgggaaccccgacgggaccgtaaccgggtagacggacggacgtacggtaaacgtttaacttacgttacggtacgtacgggtaccggtaggacgacgacgacgtacgtacgttaccccgttaggttcgggtttacgggacgggtaccgggtaaacgacggtaccgtacggtacccgtcgttcggtaccgacggacccgaacggtccgtacccgtcccccgg

SEQ ID NO: 347037 - DNA, 725 bp, Homo sapiens
  misc_feature: GZ8MTXP02IQI4T.8.12.B01.1.454.CMB.2.raw
  modified_base (539)..(539): a, c, t, g, unknown or other
  misc_feature (539)..(539): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtcccaggacagacacgccaggatccacctgcttcgtaggaagaagttaaaggttggggtaataaatatcgtcttgcttaggtatcgagcaggacggccgacggccacgtccccgtgtactggtcatactaatacaaagactaaacgacggccggaccctcgacggtactcccgtgtacgccgtacttccgtcgtccggtacctcccgtaaccgttcgtaaccgggaaccaccgaacgaccctaacctctaccgaacctcgtacgacggtacccgggacccgacgggtccgtaaacggtagtacggcggtacttacggtaaacctttagttacgtacggttcggaaccggggngggttaacgggacgacgggacctacgtaccgttaacggttacgtttcggggtttcgggggtttacgggaccggggtaacgggaaacccgtacggtccggtttacccggtaacccgggtttaacccgttccgggaacccgggttaacccgacccgggtaccgttcccgtcccccggtttacccccgg

SEQ ID NO: 347038 - DNA, 620 bp, Homo sapiens
  misc_feature: GZ8MTXP02FVJ1T.8.12.B01.1.454.CMB.2.raw
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataagtggggaataaatatgcttgctggtatcagcagagccaggccagtccccngtacnggtcatctatcaaagactaaacaaggccggacccctacgagggactccccgtagacgtccgtattctcgtcggcctccaaactcgtagggaactacacgaccactcgtcgacccataccgagggacccgggaacccgacgggtaccgttaaccgggagtacggaggaccgttacgtaaccgttatttacgtacggttacgaacgggtcggtacgggacgagaccgaggaccacgttacgttgggttacggtttcggggacgggtacggaaccgtaggtacctcggtaacccgttcgttacggtacgaccggtacccgaaggtccccgtaccgtcccccgg

SEQ ID NO: 347039 - DNA, 645 bp, Homo sapiens
  misc_feature: GZ8MTXP02FIW8I.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatcaagaataaacaagccggaccctcgagggactccctgagcgattctctcggcttccaactcgtagggaaccacagcccactcctgacccatccgacggccggggacccagggtcctaacgggagttacggacggtctcggaacttacttaccgtgtaccggaaggggtccggtggggacgacggccgacggctaacccgttaagttcgggtttacggggtttttaccggggacggggtaaacggggtaacccgaaacggtccgtaccgggtaaacccccggttcccggtttacggggtaccgaacccgggaccccgtaaaaccggggtcccgttacccggttccccccccggg

SEQ ID NO: 347040 - DNA, 577 bp, Homo sapiens
  misc_feature: GZ8MTXP02GB3LE.8.12.B01.1.454.CMB.2.raw
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (423)..(423): a, c, t, g, unknown or other
  misc_feature (423)..(423): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccaggatcacctgctctggagataaattggggataaatatgcttgctggatcagcagagcagccagtcccctgtactgtcatctatcaaagataaacaagcggccctnagggacttcccngacgcgattctctggccttccaaactctaggggaaaaccacaacnccaaacttccaggaacccaaactaccgaacggacccgggaacccacggtaccgaagganagacggacgtacgtaacttaacttacgtacgtacgacggacggtacgggacgacgacaactacacctacgtacggttacggtttcgggtacgggaacggaacgaacgacgtacgtaccgtccgtcgtacgacgaccgacgaccgtaccgtcccg

SEQ ID NO: 347041 - DNA, 682 bp, Homo sapiens
  misc_feature: GZ8MTXP02I33AI.8.12.B01.1.454.CMB.2.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaggacagacagccaggancactgctctgganataagtggggataaatatgacttgctggtatcagcagacggccagccacgtcccctgtactggtcatctatacaaagntaaacagccgccctacgaggactccgtcgagcgtattctcgcgttaccncctaactcgtacggaaccaccacgcccactacctacgaccagtccgacggacccgggaacccgacgggtacgttaaacgggacgtacgggaacggtccgtaagaacgtttaaacgttaccggttaggtaccggtacggggtaccgggtacggggaacgaaccggacggtaaccgaccgtaaccgttaacggtttcgggggtttaccgggttttaccggggaccggggtaaacgggtaacccggtaacgtacccgggtaccgtaccccgggttaaccgttcggttaaccgacccggggaccgtaaaccgggttcccgtcccggttaacccccccggg

SEQ ID NO: 347042 - DNA, 592 bp, Homo sapiens
  misc_feature: GZ8MTXP02GBEYP.8.12.B01.1.454.CMB.2.raw
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (488)..(488): a, c, t, g, unknown or other
  misc_feature (488)..(488): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatcacctgctctggagataaagttggggataaatatgcttgctggtatcagcaggagccaggccacgtcccctgtactggtcatctatcaagataacaagccgccctnagggactccgngtacgcgtattctctcggctccgaaactcgtaggggaaaccacgacgccatctacgacccagtccgaggcccgggaacccacgggacctaacgggatacggaggtactacggtaaccttagtttaacgtcggttacggaacgggtcccggtaggggaaaccncgtactactaccgtacgttagttcgggtttacgggttaccgggacggaacggacacgtccgtacgtaccgtcgtcgaccgacggaccgacgtccgtccgtcccg

SEQ ID NO: 347043 - DNA, 651 bp, Homo sapiens
  misc_feature: GZ8MTXP02FNQPA.8.12.B01.1.454.CMB.2.raw
  modified_base (223)..(223): a, c, t, g, unknown or other
  misc_feature (223)..(223): n is a, c, g, or t
  modified_base (464)..(464): a, c, t, g, unknown or other
  misc_feature (464)..(464): n is a, c, g, or t
tcagctcgcgtgtccacgaccggtgctcgatttagtagtgtagattccgcgggggctggggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcactgctctgganataagttgggaataatatgcttgctaggtatcagacgaggaggccacggcctaccgtccccgtgttacgtggtctactacgtaatacaaagataaacgaacgccggtaccctacgagggacctcccgaggtacgcgtacttccgtacgtcggaccttccgaaacgtcggtacggaaaccaccgacgaccctactactacgaaccctagacgacggaccggacccgacggtacgtaacgggngtacgacggtacgtaggtaactacgttacgtaggttaccggaggtcggacgggacacggacgacgtacgacgtttaggttacggttcggggtttacgggacggggtaacgggtaaccgaacgtcgtaccggtaccgttccggttacggtaccgtaacggtccgaaccggtcgtacccggttcccccg

SEQ ID NO: 347044 - DNA, 636 bp, Homo sapiens
  misc_feature: GZ8MTXP02HHZUL.8.12.B01.1.454.CMB.2.raw
  modified_base (450)..(450): a, c, t, g, unknown or other
  misc_feature (450)..(450): n is a, c, g, or t
  modified_base (507)..(507): a, c, t, g, unknown or other
  misc_feature (507)..(507): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagtggggaataatatgcttgctggtatcagcgagacggccaggccacgtcccctgtactgtctatctaatacaaagataacgaacggccggaccctacgagggtacctccgcggacgcgtactttccgtacgtcggacctcccgtaactcggtacgggaaaccaccgtaccgacctaccgtctacgaccactccggacgacccggggacccaggtaccgtaacggngtacgagggtactgtaacttacgtttacgacggttccggaggtacggtacgggaacncggacacggaccgtaccgtaaggttcgggttagggtttccggggacggggaacggtaaccgaagtcccgtacggtccgttaacccggtacgtaccgaccggaccgaccggtccgttcccgtccccccgg

SEQ ID NO: 347045 - DNA, 775 bp, Homo sapiens
  misc_feature: GZ8MTXP02JHL87.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagaataaagtggggaataaatagtgtcgttgctggtatcgagacaggaggaccaggccacgtcccctgtacctggtcatctatacaaagataacaagccggaccctcgaggactcccgtagacgtcgtacttccgtcgtacggtacctaccgtaaaccgttcggtaacggggaaaccaaccgtaccgacccgtacttaccgtaccgaaaccccttagtacccgaaacggggccccggggaaacccgtacggggtaccgtaaaccggagttacgggaacgtaaccgttacgtaaaccgtttagtttaaccgtcgggttaaccggaacggggtaccgggttacggggaaaccgtacgggaacccgtaaggtacccttaaacccggttaaggtttccggggttttacggggttttacccggggaaccgggggtaaaccggggtaaccgtaaaacgggtcccggttaaccgggtacccgttaaccgggttttccgggaacccgttaacccggggaccccgtaaacggggttcccccgttaccccggtttacccccccggg

SEQ ID NO: 347046 - DNA, 658 bp, Homo sapiens
  misc_feature: GZ8MTXP02HQ9JD.8.12.B01.1.454.CMB.2.raw
  modified_base (272)..(272): a, c, t, g, unknown or other
  misc_feature (272)..(272): n is a, c, g, or t
  modified_base (466)..(466): a, c, t, g, unknown or other
  misc_feature (466)..(466): n is a, c, g, or t
tcagctcgcgtgtccacgaccggtgctcgatttagtagtgtagattccgcgggggctgggcctcaggaagcagcatcggaggtgcctcagccatggcatggatccctctcttcctcggcgtccttgcttactgcacaggatccgtggcctcctatgagcttgactcacgcccaccctcagtcgtccgtgtccccaggacagacgagccaggactcaccgtgctcgtaggagtataaagttaggggaataaagtatgcttgctggtattcagntaggaggccaggcccacgtcccctgtactcggtcagtctatacaaggtaataacaaggccggaccctacgacggggactcccgtaggacgacgtacttcgtatccggtctcccgtaacgtcgtacgggaacctacacgccactctacgacccaagtccgaacggacccgggtaacccacgggtctaaaccgggngtacggacggtactacgtacttacgttacgtcgacggtagggtacggacggacgacgcgaccggtacgtacgtacggtttcgggtttacggggttaccgggacgggtaccggaccggtacggtccggtaccggtacccggttccggttacggaccgtaccggacccgaccgggtcccgtaccccggtccccg

SEQ ID NO: 347047 - DNA, 535 bp, Homo sapiens
  misc_feature: GZ8MTXP02ISVDE.8.12.B01.1.454.CMB.2.raw
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagtggggataatatgctgctgtatcagcagaggccaggccacgtcccctgtactggtcatctatcaagataacagcgcctcgaggactccgngagctagttctcgtcgctccgaacttcgacggaacacgacgcctactctacgaaccactcgacggccgggacccaggctacggatcggagactagtaactacgtttacncggtacgagggtccgnggacagcacgtctacgtagttcggttcggttcgggacggtacggactacggcctcgtaccgtcgttaggacacgaccgacggctccggtccccg

SEQ ID NO: 347048 - DNA, 667 bp, Homo sapiens
  misc_feature: GZ8MTXP02GKLMH.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataagttggggataaatatgcttgctggtatcagcgaggacgccgaggccacgtcccctgtactgtcatctatacaaagaataacaacggccgccctcacggggactcccgtagacgcgtcttacgtcgtcggcctccgtaacgtcgtacgggaaaccacgacgaccctactccgtacgaaccctagacgacgggtaccgggaacccgacggacgtacgggagtacggacggacgttagtaactttacgttaacgtcggtacgaaggggttcggacggaacgacggacacgtaccgtacgttaaggtttcgggttacgggtttaccgggggacggggtaaacggggaccctaacgggtaccgttaccgggtacccggtttaacccggtttacggaaccggtacccggaccccggtaaacgggtcccccgttacccggtccccccgg

SEQ ID NO: 347049 - DNA, 640 bp, Homo sapiens
  misc_feature: GZ8MTXP02GB09D.8.12.B01.1.454.CMB.2.raw
  modified_base (264)..(264): a, c, t, g, unknown or other
  misc_feature (264)..(264): n is a, c, g, or t
  modified_base (298)..(298): a, c, t, g, unknown or other
  misc_feature (298)..(298): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccgaggacagacagccaggactcacctgctcgtggatataagttggggaataatatgcttgctgatcagcaggngccaggccacgtcccctgtactggtacagtctanactaagaactaacgaacgccggccctacgacggtactccgtagacgtcgtacttctacgtcggtcctacccgtactcgtaacgggaacctaccgacgtaccacttccgtacgacctagccgaacgggcccggaaaccgtggtaccgtaacggagtacgggtacgtacgtacggttaatacgtttaagcgttacggaaggttcggtacgggaatccgggacacggtactaccgtttagttcggggtttacggggtttacggacggggtaaccggtaccgaaacgtcgtaaccggtccgttcggtacgtaccaccggtacccgacggtcccttcggtacccccg

SEQ ID NO: 347050 - DNA, 665 bp, Homo sapiens
  misc_feature: GZ8MTXP02GMOC5.8.12.B01.1.454.CMB.2.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtcccccaggacagacagccaggatcacctgctctgganataagtggggataaatatgcttgctggtatcagcagacggcgacggccacgtcccctgtactggtcatctanacaagtanaaacgaacgccggacccgtacgagggtacctccgtaggacgtcgtacttacgtcgtacgtcctcccgtaactcggtacgggaaccacgacncccgtactcgacaccctagtaccgacgggacccgggacccgtagggaccgtaacgggatacgggacggtacgttagtaaccgttacgtttacgcggttacggacggggtccggtaggggaactagaccgacgtaccgtaaccgttggttacgggtttcggggtttaccggaacgggggaaccggtacgaaacggtccgttaccggtaacccggtttccgttacggacctacggaccccgtaacgggtccctcccccggtttacccccgg

SEQ ID NO: 347051 - DNA, 630 bp, Homo sapiens
  misc_feature: GZ8MTXP02IHNX6.8.12.B01.1.454.CMB.2.raw
  modified_base (606)..(606): a, c, t, g, unknown or other
  misc_feature (606)..(606): n is a, c, g, or t
tcagctcgcgtgtccacgaccggtgctcgatttagtagtgtagattccgcggggctgggcctcaggaaacagcatcggaggtgcctcagccatggcatggatccctctcttcctcggcgtccttgcttactgcacaggatccgtggcctcctatgagctgactcagccaccctcagtgtccgtcgtcccaggacagacagccaggactcacctgctcgtaggagaagttaaagttggggaataaatatgtcttgctggtatcagcaggacggccaggccacgtcccctgtactgtcatctatacaagaactaacaacggccggtccctacggacgggtacctcccgtaggacgtccgtactttccgtcgtcggtacctaccctacgttccgtaacgggaaaccaccggaccaccctactacctacgaccacgtaccgaccggggacccggaaacccgacgggtaacccgttaaggacgtacgggaacgtcgtaacggtaactttacgttacgtcgtaacgggcgggtcggaacgggcacgcgtaacgctaacgtgttcgggtttacggttcggacggacgtacgacgtcgcgtacgtcgtcggacncggacccgagccctcgccctaccg

SEQ ID NO: 347052 - DNA, 546 bp, Homo sapiens
  misc_feature: GZ8MTXP02GCULH.8.12.B01.1.454.CMB.2.raw
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
  modified_base (407)..(407): a, c, t, g, unknown or other
  misc_feature (407)..(407): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggatcagcagaggcaggccacgtcccctgtactggtcatctatacaagataaacaagccggccctnaggactcctcgagcgattctctacgctccaactctcgggaacacagccactctgaccatcagcggaccnggcacgatgagctgacctattacgngtacgagaccgtgggacagcacgacgtacctaagtggttcggttttacggggacggtaacggggaccttaaacggacgttccggaaaccggttccgttacggttaccgacgacccgaaacgtcgtacccgtccccccgg

SEQ ID NO: 347053 - DNA, 514 bp, Homo sapiens
  misc_feature: GZ8MTXP02IAK9F.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctggagataattggggataaatatgcttgctggtatcagcagaggccaggccacgtcccctgtactggtcatctatcaagataacaagtcgcccctgagggactccctgagcgattctctcggctccaactcgtagggaaaccacagccactctgaccatcacggcggacccaggcgtacggatcgagctgactattactgtcgaggccgtgggacagcagcactagtgtggtttcgggcgggacggacgaacgcgtcgaccgtccgtcggtcgtacgccgacggccgtcgtcccccg

SEQ ID NO: 347054 - DNA, 605 bp, Homo sapiens
  misc_feature: GZ8MTXP02FP7B9.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtcgtccgtgtccccaggacagacagccaggatccacctgctctggagataaagttggggaataaatatgcttgctggtatcagcgagacgccaggccacgtcccctgtactggtcatctatacaagataaacacgccgccctgaggactcctagacgcgtattctcgtcggctccaactcgtaggaaaccacacgccactctcgaacccataccgacggacccgggaacccgacgggaccgtaacgggagtacggacggtcgtacgtaaccttaagtttacgtgggtaccgagggaccggtagggacgagacgtagacctaccgttagttcggtttacggggtttccgggacgggaacgggaacgtaacggtcgtacggttacccggtcgttcggacgaccgacccggacggtccgtccgtcccccgg

SEQ ID NO: 347055 - DNA, 614 bp, Homo sapiens
  misc_feature: GZ8MTXP02G4TMQ.8.12.B01.1.454.CMB.2.raw
  modified_base (221)..(221): a, c, t, g, unknown or other
  misc_feature (221)..(221): n is a, c, g, or t
  modified_base (601)..(601): a, c, t, g, unknown or other
  misc_feature (601)..(601): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctgganataagtgggataatatgctgctggatcagcaggacgcaacggccacgtcccctgtacctggtccatctaatcgaaagtactaaacaacggcgaccctacgacggggacttcccgagacgcgacttcgtacgttcggccttccgaaacttcgtaacggggaaccacgaacgccctaacttccgacgaccctacacgacggaccggacccgacggacgacggagtaggacggtgtacgtactacgtttacgtcgttacgagggaccgtagggaccgaagcgtacggactacccgtagtttaggtcggggtttacggacgggtaacgggaaccgtaacgccgtacgtaccggtccgttcggttacgacgaccgaccgggtccnccggttcccccgg

SEQ ID NO: 347056 - DNA, 722 bp, Homo sapiens
  misc_feature: GZ8MTXP02GUY27.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtgtccgtcgtccccaggacagacagccaggatccactgctctggatataaagtggggaataaatatgcttgctggtatcagcaggacggccaggccacgtcccctgtactggtcatactatacaagaataaacgaacggccggaccctacggaacggggtacttccccgtaggaacgacgtacttcgtcgtacgggccttaccgaaccttcggtaacggggaaaaccacgacgtacccaacgtacctacgaaccctactaccggacggacccggggaaacccacgggaccgtaaccgggtagacgggacgggtactacggtaactttaactttaccggagttacgggaacgggtaccggttaggggaaccacggaccgaacgtaccgtaccgttaaggtttcgggggtttacggggtttaccgggggaacgggggtaacgggtaaacccggtaaacggtcccggtaccggttaccccggttaaccggtttacggacccgtaaacccggcccggttaaacggccccgtaccccggtttccccccgg

SEQ ID NO: 347057 - DNA, 613 bp, Homo sapiens
  misc_feature: GZ8MTXP02FLOI0.8.12.B01.1.454.CMB.2.raw
  modified_base (395)..(395): a, c, t, g, unknown or other
  misc_feature (395)..(395): n is a, c, g, or t
  modified_base (481)..(481): a, c, t, g, unknown or other
  misc_feature (481)..(481): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcgtggagataaagttaggggataaatatgcttgctggatcagcagaggccaggccagtcccctgtactggtcatctatcaaagactaaacgaagccggccctcgacggatcccgtagagagtattccgtactcggctccaaacctcgtacggggaaccacacgtccactctacgactacncgacgccgggacccaggactaacggagtacggacggactacgtactacgttaaccgtgttaccggaaggtccgggtacggggaacncggacacggaccgtaccgtagttacgggttacgggttttcggggacgggtaaacgggaccgaacgtccgtacgtacccggtcgtttacgggtaccacgggtaccccgacggtcccgtacccggtccccccgg

SEQ ID NO: 347058 - DNA, 650 bp, Homo sapiens
  misc_feature: GZ8MTXP02ILDVN.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctggagaataagttggggataaatatgcttgctggtatcagcagacggccacggccacgtcccctgtactggtcatctatcaagataaacaagccgccctcgagggactcccgtgacgcgtacttctcgtcggcctcaacctcgtacgggaaccacacgccctaactctacgacctagtacgacggcccggggaacccacgggacgtaacgggtagtacgggacggtactacggtaaactttaacgtttaaccgtggttaccggacgggtcgggtacgggacacgacgtacgaccgtcgttaacggttggggtttaccgggttttcgggggaccgggtaagggaaccccgtaggtacccgttccggtaacccggtttcgttaccgggtaccaacccggggtacccaaccggggtccctaccggttcccccccgg

SEQ ID NO: 347059 - DNA, 766 bp, Homo sapiens
  misc_feature: GZ8MTXP02HXQVI.8.12.B01.1.454.CMB.2.raw
tcagctcgcgtgtccacgaccggtgctcgatttagtagtgtagattccgcggggctgggcctcaggaagcagcatcggaggtgcctcatccatggcatggatccctctcttcctcggcgtccttgcttactgcacaggatccgtggcctcctatgagctgactcagcccaccctcagtcgtccgtcgtcccccaggacagacacgccaggactcacctgctctggagaataaagttggggaataaatagtgtacttgcgttggtaatcgagacgaggaggccgacggcccctaacgtccccgttggtacgtcgggtcattacctaagtacaaaaggtaacttaaaacgaaacggcccggtacccctacggaacggggtacctcccgtggacgtaccgtactttcctcgtacggtcctccgtaaacgtcgtacgggaaccacgacgaccctactcctcgaacccatacgaccgggcccgggaacccgacggggtaccgtaaccggggagttacgggacggtaccgttacggtaaaccctttaaaggtttacccgtaggtttccgggaacggggtcgggtacggggacctaggaccgacggtaccgtaaccgtttaggttacggggttttacgggggtttccgggaacgggggtaccggggtaacccgtaaacggttcccggttccggtaacccggttccgttaaccggggttacccgaaccggacccccggtaaaccgggttccgtacccccggttacccccccggg

SEQ ID NO: 347060 - DNA, 741 bp, Homo sapiens
  misc_feature: GZ8MTXP02JC4DQ.8.12.B01.1.454.CMB.2.raw
  modified_base (307)..(307): a, c, t, g, unknown or other
  misc_feature (307)..(307): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccaggactcacctgctcgtggagtaagtaaagttggggaataaatatgcttagctggtatcagcagacggaccacggcctacgtccccgtgtactggtctatctanacaagaataacgacggccggccccgttcgacgggtaccttcccgacggacgaccgtactttccgtcgtccggtacctacctaaccgttccggtaacgggaaacccacgaccgtaccctacttccgttacgaacccgtacacggaccgggtccccgggggaaccccaacgggacccgttaacgggaccgttggggaaccgtccggttaacgtaaacgtttacgttaacggtccgttacgggtaaccggggacggttacgggaaccgtaggaccgacgtaaacccgttaccgtttaagtccgggggtttttcgggtttaaaccgggggaccggggtaaacggaaacccgtaacggtccggtaccggtacccggttaacggttcggtaaccccgtaccggaccccgtaacggtaccccgtcccgggtttcccccccg

SEQ ID NO: 347061 - DNA, 631 bp, Homo sapiens
  misc_feature: GZ8MTXP02GYSVJ.8.12.B01.1.454.CMB.2.raw
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccacctcagtcgtccgtcgtccccaggacagacagccaggatcacctgctcgtggagataagtgggaataatatgtcttgctggtacncgagacgnggacggccaaggcctacgtccccgtagtacgtggtactagtcctaatacgaaagaactaaccgaggccgtcccgtacgacggtactccgtcgacgtcgtacttcgtactcggtactccgtaaacgtgtacggaacaccgtacgccctaccgtcgacaccgacgtcgaacggcccggaccgacggaccgtaaggaccagggtacgtacgtacgtacttaacgtttacgacgttcgaaaggttcggacggacgtaacgacgtaacgtaaccgttagttgggttaccggtttacgggacgggtacggaacgtaacgtcgtaccgtcgttccgtaagtccgaacgacgtaccgtccgtcccgccccggttacg

SEQ ID NO: 347062 - DNA, 626 bp, Homo sapiens
  misc_feature: GZ8MTXP02GA3SJ.8.12.B01.1.454.CMB.2.raw
  modified_base (270)..(270): a, c, t, g, unknown or other
  misc_feature (270)..(270): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggatcacctgctctggagataagtggggataatatgcttgctggtatcagcaggcggaccaggccncgtcccctgtacctggtacattactatcaagataaacgacgccggaccctgacggtactcccgtgacgtcgtattctcgtcgcctccactcgtacggaacacgacgccactcctcgacccataccgacgggacccggacccgaggaccgtaacggagacggtacgcgtacgtacttacgttacgtggtacggacgggtcggtacggggaacacggacgacgtaccgtacgttaggttcgggtttacggggttaccgggaccggggtaacggtaaccgtacggtaccgtaccgggtacccggttcggttacggtacccgtaccggtacccggtaccggtcccgtacccggtcccccg

SEQ ID NO: 347063 - DNA, 703 bp, Homo sapiens
  misc_feature: GZ8MTXP02HWIJ8.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccaggatcacctgctctggagataaagttggggataaatatgtcttgcgttggtatccagcgaggacggccgaacggcccctacgtccccgtgtacctcgggtcatacctaatccaaagtaataaacgaagccggacccgtacgacgggtactccccgtagacgtccgtattcctcgttcggcttccgaactcgtacggggaccacacgccctaactcgtacgaccctagtcgaaccggacccgggacccgacggtaccgtacggagttacggacgtcgtaggtacttacttaccgtagttcggacgggacggtacgggacgaaacggcctaacggtaccgtacccgtttaaggttccgggttttacgggggtttttacccggggaccgggggtaaaccggggtaaccgtaaccgggtccgtaaccgggtacccgttcccgggttttacggaccgtacccgggaaccgtaaccccgggtaccgtttcccccgtccccccggg

SEQ ID NO: 347064 - DNA, 673 bp, Homo sapiens
  misc_feature: GZ8MTXP02IKY99.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccaggatcacctgctctggagaataaagttggggaataaatatgacttgctaggtatcgagcaggacggccaggcccacgtcccctgtactggtcatctatacaaagataaacaagccgccctcgacggactccgtacgacgccgtattctcgtcggcctccgaaacttcgtacgggaaccacgacgacctactctacgaaccacgtacgacggcccggaccgacggtaccgtacggacgtacggacggtactacgtaactttaacgtttacgttacggtaccggtacgggtacggtacgggtaacgaacgaccgtaacgcctaaccgttaacggtttcgggtttacggggttttccgggaccggggtaaacgggtaaccgtaaacggtccgttaaccgggtacccggttaaccggttacggtacccgaccggtacccggtaaaccggtcccggttacccggtccccccgg

SEQ ID NO: 347065 - DNA, 611 bp, Homo sapiens
  misc_feature: GZ8MTXP02F2NAQ.8.12.B01.1.454.CMB.2.raw
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctancaagataacaagcggccctgaggactcctgagcgatttcnctggctccaactcgtagggaacacgagacccactctcgaccactcgacggcgggacccacggacgtaacgggagtacgacggcgtacggtaacttacgttaccgtaggttacggaggtaccgggtaggggacgacgacgtacggacctaaccggttaacgttcgggttcgggtttttccgggggaccgggggtaacggggtaccgaaaacgggtccgtcggtacccggttccgtttacggtaccgaccgtacccgaacggtaccgtccggtccccccgg

SEQ ID NO: 347066 - DNA, 688 bp, Homo sapiens
  misc_feature: GZ8MTXP02FQKMV.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtcccaggacagacagccagactcacctgctcgtaggaagtaagtaaagttggggaataaagtatgtcttgctaggtatcgagcgaggacggcccgacggcccgtacgtccccgtagtactcggtctaatctactacgaaagtaataaaccgacgtccggaccctacgacgggtactcccgtacgacgtccgtattcgtcgtacggcctaccgtaacgtcgtacggtaaccactacgaccctacttacacgtacccactacggacggaccggaccgtacggacgtacggaagtcggaacggtactacgtaacgttacttacgttacgtacggtaagggccggtagggaccacggcgaacggtacctaaaccgttgtttcggggttacggggttttaccgggacggggttaaaccggaacgaaccggtccgtccgggttaaacccgttcccgttcggtaaccacccggttacccggaacgttccggtaccccgtttcccccgg

SEQ ID NO: 347067 - DNA, 761 bp, Homo sapiens
  misc_feature: GZ8MTXP02JT760.8.12.B01.1.454.CMB.2.raw
  modified_base (219)..(219): a, c, t, g, unknown or other
  misc_feature (219)..(219): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtcccaggacagacagccaggatcacctgctcgnggagataaagttggggaataaagtatgcttagctaggtatcgagcgaggaggccaggccagtcccctgtacnggtcatctatanaagtaataacgaacggcggtccctacgacggggaactcccgtagacggtactactttctcgtacgggtcctacctaaaccgtcgttacggggaaacctacgaacggccctaaactcctacgaacccacgtaccgaacggccgggggaaccccgtacgggaccgttaacgggaacgttacgggaacggtaccggtaacgtaaacgttaccgtttacgtacgggttaccggttaaacgggggcccgggttagggggaacccgtaagggtacccgacggtaacccgttaacccggttaaagtttcgggggtttaaacgggggtttttccgggggaaccgggggttaacgggaaaacccgtaaacgggtccggtttaaaccggtcccccggttaacggtttacgggtaaccggtacggacccccggtaaaacgggttcccgtccccggtttaacccccccgg

SEQ ID NO: 347068 - DNA, 632 bp, Homo sapiens
  misc_feature: GZ8MTXP02G8AIT.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtgtcccccaggacagacagccaggatcacctgctctggagataaagttggggaataaatatgcttgctggtatcagcagaggccaggccagtcccctgtactggtcatctatcaaagataacaagccgccctagacgggactcctagacgcgtacttctctcggacctccaactcgtacgggaaccacgacgaccctactctacgaccatccgacggccgggaccaggcctaacggactacggacggtctagtaacttacgtactcggtacgaggtccggtaggggacacggacacggtacctacgttacggttcgggtttacggggtttaccggggacgggggtaaacggggtacccgtaaacggtcccgtaccgggttacccggttaaccgttcgggtaaccgaccggtaaccccggaacgggtccccgtcccgggttaccccccgg

SEQ ID NO: 347069 - DNA, 665 bp, Homo sapiens
  misc_feature: GZ8MTXP02F3P9O.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggactcacctgctcgtggagataaagttggggaataatatgcttgctggtatcagcgagaggccaggccgacgtccccgtgtacgtggtctatctatacaagaataacaacgccggccctacgagggactccgtgacgtacgtatttccgtcgtcggtacctaccgaaccttacggtacgggaaaccacacggccctaactctacgaaccctagaccgacggacccggggacccgtacgggtaccgtaacgggtacgttacgggacggtacgtacggtaacttacgttacgtcggttaccgggaggtacccggggtagggaaccgacggaaccggataccgtaacgttagttcggggtttcggggtttaccggggacgggtaacgggaaccgttaaacgggccgtacgggtaccgttcgtacggtacgacccggaccgtacggcccgtaccgttcccccg

SEQ ID NO: 347070 - DNA, 583 bp, Homo sapiens
  misc_feature: GZ8MTXP02JFJLC.8.12.B01.1.454.CMB.2.raw
  modified_base (435)..(435): a, c, t, g, unknown or other
  misc_feature (435)..(435): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagaggccaggccagtcccctgtactggtcatctatacaagataacaagccgccctcgaggactccctagacgcgattctacgtcggcctccaactcgtacgggaacacacgcctactctcgaccatcgacgccgggaccaggctacggatgagcctagtactattacgtgtcgacggnggtgggaaccaggacaggtacctaaccgttgttacggttcgggttttacgggaccgggtacgggaaacccgtaacgtaccggtacggttaacccgttccgttaggtaccgtaaccgacccggaacggtccggtaacccgttcccccgg

SEQ ID NO: 347071 - DNA, 623 bp, Homo sapiens
  misc_feature: GZ8MTXP02I0A14.8.12.B01.1.454.CMB.2.raw
  modified_base (349)..(349): a, c, t, g, unknown or other
  misc_feature (349)..(349): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggatccacctgctcgtggagaagtaaagttggggaataaattatgtcttggcttggtatcgagcaggacggccacggccacgtcccctagtactggtacatactatacaaagactaaacgagccggccctacgaggtactcccngacgctattcctacgtcggactcctaacgtcgtacgggaaccacgacgcctacttcacgaccacgtacgacggtacccggggaaccacggtaccgtaacggtagaggacggtcctaggaacctttacgttacgtcggtcgaaggggtcggtcgggaacacgggacacgaccgtaccgttagtttcgggttacgggtttacggacggggaccggtacgacgtcggtacgtacccgtcgttacgtaccgaccgtacgaccgtcgtcccgtaccccg

SEQ ID NO: 347072 - DNA, 772 bp, Homo sapiens
  misc_feature: GZ8MTXP02GR5XR.8.12.B01.1.454.CMB.2.raw
  modified_base (624)..(624): a, c, t, g, unknown or other
  misc_feature (624)..(624): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacagccaggactcacctgctcgtaggaataagtaaaggttggggaataaagtagtcgtcgttaggcttaggtactcgagacgaggacggccgacggcccacgttcccctagtaccgtcggtactactactaagtacaaagtaactaaaccgacgcccggtaccctacggagggtacctacccgtgaacgaccgttacttccgtcgtaccgtacccttaccctaacgtaccggtaaacgggaaaccaccggaaccacccctaacgtacccgtacgaacccttacggacccgaacgggtacccccggggaaacccgacggggttaaccggtaaacccggggtagtacggggacggttaccggttaactaaacccgtttagtttaaccgttacggtaacgggtacggggaccgggttacgggaaaaccncggacgttaaccgaccgttaccgtaagggtttcggtttacggggttaccgggaacggggtaaacggtaccgaacggtaccgttacccggtaaccgttcggttaccggacgtaacccggccgtaaacggcccctcccggttacccccgg

SEQ ID NO: 347073 - DNA, 685 bp, Homo sapiens
  misc_feature: GZ8MTXP02FG8DB.8.12.B01.1.454.CMB.2.raw
  modified_base (217)..(217): a, c, t, g, unknown or other
  misc_feature (217)..(217): n is a, c, g, or t
  modified_base (438)..(438): a, c, t, g, unknown or other
  misc_feature (438)..(438): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcnggagataaagttgggggataaatatgcttgctggtatcagcagaggccaggccagtcccctgtactggtcatctatacaagataaacaaggccggaccctcgaggggactccctgacgcgattcctcgtcggctcccaaacgtcgtaggggaaaccacgacgccctaactctacgacccagtaccacggacccggggaccccgacggccgttaaaccgggngttacgaagggaccgttaggaaacctttacgtttaaccgttacgggtttaccgacgggggtaccggttacgggggaaccgaacggcgacgaccgtaacccttaaggttcgggtttacgggggtttttaccggggaccgggggaaacggggttaacccaacgggtaccgtacgggtaccccggttaacccggtttcgggtaaccaccgggtaccccgaaacgggtcccgtaccccgggttcccccccg

SEQ ID NO: 347074 - DNA, 584 bp, Homo sapiens
  misc_feature: GZ8MTXP02GUHYJ.8.12.B01.1.454.CMB.2.raw
  modified_base (223)..(223): a, c, t, g, unknown or other
  misc_feature (223)..(223): n is a, c, g, or t
  modified_base (435)..(435): a, c, t, g, unknown or other
  misc_feature (435)..(435): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccaggactcacctgctctgganataaagttggggaataaatatgtcttgctggtatcagcagacggccaggccacgtcccctgtactggtcatctatcaagaatacgaagccgccctagaggtactccgtagacgtctacttctcgcgcctccaacttcgacgggaccacgacgccactctacgaccatcgagcccgggaccaggctacggatcggagtctagtactagttacngtcgagcgtaggacaggctacgcgtacgtacgttcgggttcgggtttcggacggggttacggaacgtacgggtaccgttaccgggtacccggtttaaccgttcgggaccgaccggttacccggaacggtccgtaccccggttcccccgg

SEQ ID NO: 347075 - DNA, 777 bp, Homo sapiens
  misc_feature: GZ8MTXP02IHWTK.8.12.B01.1.454.CMB.2.raw
  modified_base (256)..(256): a, c, t, g, unknown or other
  misc_feature (256)..(256): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccgagacagacacgccaggatcacctgctctggagataagtagggaataatagtgcttgctggtanacgagacgagacggaccgaggaccctacgtccccctggtactggtactatacgtaatacgaaagaactaacgaacgtccgacccgtacgacgggtacctaccgtcgacgtccgtactttccgacgttccggacctcccgtaaacgttaccgtaccggggtaaaccaacccgtacggacccctacccgtacgttaaccggaaccctaacgtccgaaccggggtaccccgggaacccgaacggggtaccgttaacgggacggtaacgggtaacgacccggttaacgtaaaccgtttaacgtttaccggtacggttaccgggtaaccggggtacggggttaacggggaaccgtaacggaccgtaacgtacccgtaacgtttacgggtttacgggttccgggggtttttaaccgggaccggggttaacgggaaaccgttacgggtacccgtttacggacccggtttaaccgtacgggtacccgtacccggacccggtacggtaccccgttccccggtacccccgg

SEQ ID NO: 347076 - DNA, 645 bp, Homo sapiens
  misc_feature: GZ8MTXP02JLLLH.8.12.B01.1.454.CMB.2.raw
  modified_base (295)..(295): a, c, t, g, unknown or other
  misc_feature (295)..(295): n is a, c, g, or t
  modified_base (403)..(403): a, c, t, g, unknown or other
  misc_feature (403)..(403): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaagttggggataaatatgcttgctggtatcagcagacggccgaggccacgtcccctgtactggtcatctanacaagtataaacagccgacccgtacgaggggtactccgtacgagccgtattccgtctcggactccaacgtctacgggaaaccacgacgcctaactcgtacgacctacncgacggacccgggacccgacggacgtacgggacgtaggacggtcgaggtaacttacgttacgtcggttacgacgggtacggtacgggaacgtagaccggtagtaccgaacgttacggttacggttcggggttttaccggggaccggggtacgggtaaaccgtaacgggtccgtacggtaacccggttcgttacgggtacccgtaaccggacccggtaacggccccggttacgtaccccccgg

SEQ ID NO: 347077 - DNA, 816 bp, Homo sapiens
  misc_feature: GZ8MTXP02F5CMY.8.12.B01.1.454.CMB.2.raw
  modified_base (341)..(341): a, c, t, g, unknown or other
  misc_feature (341)..(341): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccgaggacagacagccaggactccactgctcgtggaagtaagttaaaggttaggggaataaagttagtgacgttaggcttaggtactcgagcaagggacggcccgacggcccgtaaccgtccccgtgtactcggtcactactacacgaaanaactaacgacgccggtaccctacgaggacctccgacgagtcgtattcctcgtacggtaccctaccgtaacctacggtaacggaaacctaacccgaacgtacccgaaccttcccgtaaccgtaacccgtacttaccggaacccgggggtaacccccggggaaacccccgggtacggtacccgggtttaaaaaccgggggtacgggtaaaccggtaacgggttaaccgtttaacgttaaaccgtttaaaccggtttaccggtaccgggtaacggggtaccgggtaaccgggtaaccggggaaccgaaccggtaaccgtacggtaccgttacgtttaacggggtttccggggtttacggggttaaccgggggacggtaaaccgggtaaccggtaccgtacggttacccggtaccgttaaccggtaccgtacccggaacccggtaccccggtaccggtcccccgtccccggtaccccgg

SEQ ID NO: 347078 - DNA, 634 bp, Homo sapiens
  misc_feature: GZ8MTXP02HXA99.8.12.B01.1.454.CMB.2.raw
  modified_base (313)..(313): a, c, t, g, unknown or other
  misc_feature (313)..(313): n is a, c, g, or t
  modified_base (356)..(356): a, c, t, g, unknown or other
  misc_feature (356)..(356): n is a, c, g, or t
  modified_base (438)..(438): a, c, t, g, unknown or other
  misc_feature (438)..(438): n is a, c, g, or t
  modified_base (534)..(534): a, c, t, g, unknown or other
  misc_feature (534)..(534): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgaggacagacacgccgaggactcacctgctcgtaggagtaagtaaggttggggaataatatgtcttgcgtgtatacgagacgagacgcacggcctacgtcccgtgtactggtcatactanacaatacgtaacgacgccgaccgtacggacggaccttaccggngacgtccttacgttctcggtccgacctaccgtaacgttaccggaacggaaccacgtaccgacctacgttcgaacgaccgtanaccgggccggaacccgggtacccgaacgggttacgacggtacgtaggacgtccgttaaggtacttaacgttcgcgttaggacgggtcggaggacgngacgaccgtacgtacggttgttcgggtttcgggaccgggacggtaacgacgacgtccgtcgtaccgtgttacggcaccgcgtacggtcctacccgtcccg

SEQ ID NO: 347079 - DNA, 680 bp, Homo sapiens
  misc_feature: GZ8MTXP02IYQU0.8.12.B01.1.454.CMB.2.raw
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtcgtcccgtcgtccccgaggacanacggacnccagactcacctgctcgtggaagtaagttaaaggttggggtaataaatagtgtcgttgcgttaggtactcgagcgaggacggaccacggccctacgtcccctagtacgtggtacattacatacaaagtaactaaacgacggcccgtcccgtacggacgggtacctcccgtaggacgtaccgtacttccgtcgtaccggtacctccgtaacgttccggaacgggaaacctacgaccgcctaccgtccaacgaccctacgaaccgacccgggacccgggaacccgtaggaccgtaacgggtagtacgggacggtccttaacggtaactttaacgttcgtacgggtacggacggggtacggtacggacgacgtacggactaccgttacgtaggttcggtttacgggtcggacggtacgtacgacgtacgtccgtacgtcgtacgactaccgaccgaccggttccgaccctcccgg

SEQ ID NO: 347080 - DNA, 638 bp, Homo sapiens
  misc_feature: GZ8MTXP02HH2MF.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccacctcagtgtccgtcgtccccaggacagacagccaggatccacctgctctaggagaattaaaggttaggggtaattaaagtagtgtcttgacgtggtactcgagcgagacgccgacgccgtacgtccccgtgtacgtcggtactactactatacaagtaactaacgaacgtccggaccctacggacgggtacctccgtagacgtaccgtcttccgtcgtaccgcctaccgtacgtcgtacggaacacgcacctactcgacacacacgacggaccgaccgtacggcgtaaccggagacgacgctaacgtacttaccgttagtaggttcgaacggcggacggacgacgacgacgtacctaccgtagttggttaccggtttacgggacggtaaccggacgaacgtaccgtccggtacccgttccgttacggacccgtaccgaaccgaccgtaccccgttcccggtcccccg

SEQ ID NO: 347081 - DNA, 615 bp, Homo sapiens
  misc_feature: GZ8MTXP02HMA8D.8.12.B01.1.454.CMB.2.raw
  modified_base (164)..(164): a, c, t, g, unknown or other
  misc_feature (164)..(164): n is a, c, g, or t
  modified_base (271)..(271): a, c, t, g, unknown or other
  misc_feature (271)..(271): n is a, c, g, or t
  modified_base (326)..(326): a, c, t, g, unknown or other
  misc_feature (326)..(326): n is a, c, g, or t
  modified_base (449)..(449): a, c, t, g, unknown or other
  misc_feature (449)..(449): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactnacgcccaccctcagtcgtccgtcgccccaggacagacagccagactccaccgtgctcgtaggagtaagttaaaggtaggggaattaaagtagtgtcgtgacgtagtntcgagcgacgacggccgacggccgacgtccccgtagtacgtggtactactactanactaagaactaacgaacgccggtacctacgtaacggccgttaccgagaccgtacgtacttcctcgtccggtactccgttacgtacgtacgggaaacctaccgacgacctcacgtacaccgtanaccggaccgggcccgaccgaccggtacgtacggtagacggcgactagtacttacttagtccgtaggcgggtacgnggacagaccgtanccgagttacgtgggttcggtcgacgggtacgacgacgtcgccgttacgtcgtcgcctacgcgtactccgtcgtccccg

SEQ ID NO: 347082 - DNA, 685 bp, Homo sapiens
  misc_feature: GZ8MTXP02HTVQW.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccacctcagtgtccgtgtccccaggacagacagccaggatcacctgctctggagataaagttggggataaatatgctgctggtatcagcagagccaggccacgtcccctgtactggtccatctagtcaagtataacagcgcctacgaggactccgtacgagtccgtattccgtacgtcgggtcctacccgaacgtaccgttacggggaaacctacgaccggtaccctaccgttacctacggaaccctaacgtacccgacggtacccgggggtaccccgaacggggtaccggttaaccgggaagttacgggacggtaccgttacgtaaacgtttaacgtttaacgtcgggtttacgaacgggccggttacgggtaacccgagggaccgaggacccgtaacgttaacggtttccgggttacgggtttttacggggacgggtaacgggaaccgttaacggccgtacggtacccggtccgtttcggacctacggcccgaacggtcccgtaccggttcccccg

SEQ ID NO: 347083 - DNA, 725 bp, Homo sapiens
  misc_feature: GZ8MTXP02IO2X7.8.12.B01.1.454.CMB.2.raw
  modified_base (217)..(217): a, c, t, g, unknown or other
  misc_feature (217)..(217): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctcnggagataaagtggggaataaatatgctgctggtatcagcagacggcaggccacgtcccctgtactgtcatctanacaanactaaacaggcgccgacgacggacgtccncgacgacgtacttactcgtcggtctacctaaccgtacgtacggaaccgaaccaacgacctacctaccttcgaaacccgacctacgaccggaaccgggccccgaacgtaccggtaaccgacgttaggacggtaaccggtctaaacgtttaacgtttaccgtaggttaccggggtacggacgggttaccggggaacttacgacggttaaacctaccggttaaaccccgtaagttttcggggtttaccgggggtttttaaccggggtacgggggaaccgggtaaaacccggtacggtacccggtttaacccggtacccggggttaacccgtttcggggttaacccggaaccgtacccccggggtaaacggtacccccggtttaccccgtaccccccccggggg

SEQ ID NO: 347084 - DNA, 692 bp, Homo sapiens
  misc_feature: GZ8MTXP02GD300.8.12.B01.1.454.CMB.2.raw
  modified_base (220)..(220): a, c, t, g, unknown or other
  misc_feature (220)..(220): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcaggatcacctgctctgganataaattggggataatatgcttagctggtatcagtcgagacggccagccgactccccgtgtacgtgtactatctaatacgaagaactaacgaaacggccggtaccccctacgaacggggactttccccgagaccgtcgtaacttctcgtcgggtcctacccgaaacctccgtaggggaaacccacgtacgaccctaaccgttaccgaacggtaccaattacccgaacgggacccggggacccgacggaccggtaaacccggtagttacggacggtacgttacggtaaccttaacgttaacgttcgggttacgacggggtacggttcgggaaacgtacggacacggtacccgaacgttcgtttacggttcggggttttaggacccggggtaaggacccgaaacggtcgtacggtaccggtccgtttacggaccgtaacggacccgtaaacgggtccgttaccgtaccccccgg

SEQ ID NO: 347085 - DNA, 646 bp, Homo sapiens
  misc_feature: GZ8MTXP02HAZA0.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtcccgaggacagacacgccaggactcacctgcctcgtggaagtaagttaaaggttaggggtaataaagttagtgtcttgcgttaggtactcagacgaggacgacgacggccgtacgtccccgtgtacgtcgtactacgtactatacgaaagtaactaaacgacgtaccggccctaggacggtacttccgaggacgtcgtacttcgtcgtcggtacctccgtaacgttcggacgggaaccacgacgccctaactcgtacacctacgacgacggacccggacgcgacgtacggacgtacgaacgggtctacgttaaacgtcttaccgtaggcggtaccggacggacggaacgcgacgcgtacgtaaccgttgttggggttaccggttagggaccggtagggacctaggtaccgtacgtaccgtcggtcgacgacggaccgtacgtcccgcgttacccccg

SEQ ID NO: 347086 - DNA, 841 bp, Homo sapiens
  misc_feature: GZ8MTXP02GODLU.8.12.B01.1.454.CMB.2.raw
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccacctcagtcgtccgtcgccccaggacagacagccaggactccactgctcgtggaagtaataaggttaggggaattaaatatgcttgcgtaggtatacgagcgacgacggccgacggcctaccgtcccctagtaccgtggtactacgtactataacgtaacgaactaaaccgacggtcccggacccgtacggtaacgggtacctcccgtaggaaccgtcgtacttccgtacgtccggtacctaccgtaacgtaccggtaaggtaaccctaacgtccggtaaaccctactacccgtaccgtaaaccgttacccgtacccgggaaccgggacccccgggtaaccccggtaacggggtaaccggttaacccgggggtaggtaacccggggtagggtacccgttaaccgttaaacgttttaacggttaccgtttaacgggaccgggtaccggggttaccggggtacggacgaaccggttaccggaaccggtaacccggtttacgtaacgggtttacggggttaccgggggtttaaccggggaaaccggggtaaaacccggggtaccgtaaaccggggtaccccggtaccggtttacccccggtaacggttaaccccgggttacgaaccccgggttaacccggacccgggttaccccggtacccccggtttcccccgg

SEQ ID NO: 347087 - DNA, 653 bp, Homo sapiens
  misc_feature: GZ8MTXP02HU7PD.8.12.B01.1.454.CMB.2.raw
  modified_base (175)..(175): a, c, t, g, unknown or other
  misc_feature (175)..(175): n is a, c, g, or t
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
tcagctcgcgtgtccacgaccggtgctcgatttagtagtgtagattccgcggggctgggcctcaggaagcagcatcggaggtgcctcagccatggcatggatccctctcttcctcggcgtccttgcttactgcacaggatcgtggcctccgtatgagctgactcagcccaccctnagtcgtccgtcgtccccgaggacagacacgccgaggactcacctgctcgngagtaataagtagggaataaatactgngtacgtcgtgtatacagtacgagacgcgacggacctacgtccccgtagtacggtacggtcctagtcctaataccgaaaagaagtaaacgaacggccggacgcgaaacggtcgtaccgtagacgactaattctgttacggacttaccacgttacgaggaccanaccgtacactaccgaanaccacgacgacggacccgacgaggacgaacgacgtacgaacgagttaataacttacgttacgtacggtagggacggtagaaggactaacgactacgacgtaacgttaggttacgggttacggggttacgggtaacgggaaacgggtaaccggtaacgtaccgtaccggtaccgttaacggtacgtaaccgtaccgacccggaccggtaccgtacccgtcccg

SEQ ID NO: 347088 - DNA, 493 bp, Homo sapiens
  misc_feature: GZ8MTXP01EPZI6.3.38.D05.1.454.CMB.2.raw
  modified_base (270)..(270): a, c, t, g, unknown or other
  misc_feature (270)..(270): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatgtatcagcagaaaccaggaancccctaaagctcctgatctatgctgcatccagtttgacaaacgtggggtccatcaaggttcagtgcagtgatctgggacagatttcactctcaccatacaactagtctgacaactagaagtattttgactaaacttactactgtacaaacagtatttccaccttaccctctctacgtttcgggcggggaccaggtgagnttacaaagactgngcttgcaactn

SEQ ID NO: 347089 - DNA, 522 bp, Homo sapiens
  misc_feature: GZ8MTXP01BLYU4.3.38.D05.1.454.CMB.2.raw
  modified_base (506)..(506): a, c, t, g, unknown or other
  misc_feature (506)..(506): n is a, c, g, or t
tcagagacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaattggtatcagcagaaaccaggaaacgacccctaagctcctgatctatgctgcatccagtttcgctaaaggtcggggtacccatacaaaggttcgagtggcagtggatcgtgggacagtatttcactctacaccataccaaacacgtactgactaacctaggggtaaatattttacactaaacttactactagtacaactagtattcacctaaccctcttctacgttcgggcggggaccagggttgagaatacgaanacgtgagtcgttgaac

SEQ ID NO: 347090 - DNA, 522 bp, Homo sapiens
  misc_feature: GZ8MTXP01BPDXR.3.38.D05.1.454.CMB.2.raw
  modified_base (221)..(221): a, c, t, g, unknown or other
  misc_feature (221)..(221): n is a, c, g, or t
  modified_base (270)..(270): a, c, t, g, unknown or other
  misc_feature (270)..(270): n is a, c, g, or t
  modified_base (444)..(444): a, c, t, g, unknown or other
  misc_feature (444)..(444): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagcagaaaccaggaancccctaagctctgatctatgctgcatccagtttgcaaaggtgggtaccatcaagttcagtgcagtgatcgtgggacagtatttcacttcacaccatacaacagtctgactaactgtaagtattttgactaaacttactactgtaccaataaggtactttccaaccttacccctntaactccgtttcgggggacggggacctaaagggtgaacgcttaacgaaacgtacgtggtacggcttacgtcaaccgtg

SEQ ID NO: 347091 - DNA, 537 bp, Homo sapiens
  misc_feature: GZ8MTXP01A5Q3U.3.38.D05.1.454.CMB.2.raw
  modified_base (273)..(273): a, c, t, g, unknown or other
  misc_feature (273)..(273): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaancccctaaagctcctgatctatgctgcatccagtttgactaaaggtcggggtaccatcgaaggttcagtggcagtggatcgtgggacagtatttcactctcaccatacaactagtctgacaacctgaaacgtattttcgactaaacttactactgtactaaacagtactttccaccttacccctctaacctaacgtttcggggaccgggggacctaagggtggaagttcttacgaaacgtactggtcggcttacgcgaacctaag

SEQ ID NO: 347092 - DNA, 700 bp, Homo sapiens
  misc_feature: GZ8MTXP01CAGC9.3.38.D05.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggganaagtcagagcatagcagtacttaattaaattgtatacagacaaagaaaccgaaggaaaccacccctaagcctacctagtactactatgctgactattacctagtttacgaacgtaaacggtcgggtacctaagtacgtaacggttacgaggtgacgtagggtggtacgtcggtacgggactaagttactttaccaccttacctaccaacctaataccgaaacgtacgtactacgacctaaaccgttagtaaagtttacgttttacgtaaccttaaacctttaaccgttaaccgttacgttaacctaaacgttaacgttaaccgtttaccctaacccctttacccccttccggttaaccgttaacccgggtttaccgggggaaccgggggttaaaccgtaaaggggtacggaacgttaacgttaaaccgtaaaaccgtacgttcgggtacggtacgttacgtaaccgttaaccgtaacg

SEQ ID NO: 347093 - DNA, 499 bp, Homo sapiens
  misc_feature: GZ8MTXP01BOXA9.3.38.D05.1.454.CMB.2.raw
  modified_base (276)..(276): a, c, t, g, unknown or other
  misc_feature (276)..(276): n is a, c, g, or t
tcagagacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaancccctaagctcctgatctatgctgcatccagtttcgcaaagtggggtcccatcaaggttcagtggcagtggatctgggacagatttcactctcaccatcaacagtctgacaacctggaagtattttgactaacttactactgtacaactagtatttccactaaccctcttctacgttcggcgggggacaagggttgagaatacaacgactgttggcttgaacc

SEQ ID NO: 347094 - DNA, 500 bp, Homo sapiens
  misc_feature: GZ8MTXP01AWGLO.3.38.D05.1.454.CMB.2.raw
  modified_base (270)..(270): a, c, t, g, unknown or other
  misc_feature (270)..(270): n is a, c, g, or t
  modified_base (436)..(436): a, c, t, g, unknown or other
  misc_feature (436)..(436): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaacagggaancccctaagctcctgatctatgctgcatccagttgcaaagtgggtccatcaaggttcagtgcagtggatcgtgggacagatttcactctcaccatacacagtctgacaacctgaagtattttagctaacttactactgtacaactagtacgtttcaccttacccctntcctacgttcgggacgggggttaccaagggtgagcttacaaacgactgtggacttgcaacctaa

SEQ ID NO: 347095 - DNA, 513 bp, Homo sapiens
  misc_feature: GZ8MTXP01CUCLI.3.38.D05.1.454.CMB.2.raw
  modified_base (427)..(427): a, c, t, g, unknown or other
  misc_feature (427)..(427): n is a, c, g, or t
  modified_base (481)..(481): a, c, t, g, unknown or other
  misc_feature (481)..(481): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaatggtatcagcaagaaaccagggaaacgcccctaagctcctgatctatgctgcatccagtttgcaaacgtggggtaccatcaaggttcagtgacagtgggatcgtgggacagtatttcactctcaccatacaactagtctgacaactagaagtattttgactaacttactactgtacctaanagtcttcacctacccctctctacgtttcgggacgggggaccgtaaaggtggagnttacaaacgaactggtaggcttgccaacctaa

SEQ ID NO: 347096 - DNA, 515 bp, Homo sapiens
  misc_feature: GZ8MTXP01B1SUT.3.38.D05.1.454.CMB.2.raw
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
  modified_base (391)..(391): a, c, t, g, unknown or other
  misc_feature (391)..(391): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagcagaaaccaggaaacncccctaagctcctgatctatgctgcatccagtttgactaaacggtcggggtaccagtccgaaaggttcaggttggcaggtggatcgtggggacagtatttcactcacaccatacaacngtctgacaactgaagtattttgactaacttactactgtacaatagtatttccacctccctntaacgtcgtttcggggcggggaccaagggtgagttanacgaaagactgtaggcttagcaactc

SEQ ID NO: 347097 - DNA, 555 bp, Homo sapiens
  misc_feature: GZ8MTXP01CXH6F.3.38.D05.1.454.CMB.2.raw
  modified_base (397)..(397): a, c, t, g, unknown or other
  misc_feature (397)..(397): n is a, c, g, or t
  modified_base (524)..(524): a, c, t, g, unknown or other
  misc_feature (524)..(524): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggcaagtcagagcattagcagcttaattaaattggtatcagacaagaaaccagggaaacgacccctaaagctcctgatctatgctgcatcctagtttgactaaacggtcggggtaccagtcgaaggttacaggtggactaggtggatcgagggactagtatttcactctacacctanacaacagtctagactaaacctagtaaacgttattttacgacttaaacttacttactagtacaaactagtactttccaccttacccctctaacgtacgttcggggaccggggacgaaagggtgaacgnttacaaacgactggtggcttagccaacgtaa

SEQ ID NO: 347098 - DNA, 677 bp, Homo sapiens
  misc_feature: GZ8MTXP01A8UB8.3.38.D05.1.454.CMB.2.raw
  modified_base (241)..(241): a, c, t, g, unknown or other
  misc_feature (241)..(241): n is a, c, g, or t
  modified_base (448)..(448): a, c, t, g, unknown or other
  misc_feature (448)..(448): n is a, c, g, or t
  modified_base (660)..(660): a, c, t, g, unknown or other
  misc_feature (660)..(660): n is a, c, g, or t
tcagagacgcactccacgaccggtgctcgatttagtatctgatagttgggtttgggggcaggagtcagtctcagtcaggacacagcatggacatggacgggtccccgctcagctccgtggggctcctgctactctggctccggaggtgccagatgtcacatccagatcgacccagtcctccactccctccctgtctgctatcgtggtaggagacagacgtccactatcacgtcggccgganagtcagagtctagtagactagtacttaaagttaagtggtaactacgaacgaaccgaaacggaaaccggaaacgggaaaccctacccctaagtcctaccgtagtacttctagtcgtacgtacacttacgtccgttaaggttacccggaacggtaacgggtccggtacctagtaacgggtacgttcgagggtcgacgtagtaggtacgnggtacgactattcttaccacttcccgacaacctataaccgaagtacgtactaccgtaaaccttacggtaattaacggtttacttaaccgaacctttaacttactacgtaacgtaaacctacgttaccttaccgtttacccaccccgttaacgtcgttacgggggtcggttacgggggaacgtaacggagttcggaactaacgacgtaacggngtcggttctccttcgtc

SEQ ID NO: 347099 - DNA, 538 bp, Homo sapiens
  misc_feature: GZ8MTXP01ECRDL.3.38.D05.1.454.CMB.2.raw
  modified_base (278)..(278): a, c, t, g, unknown or other
  misc_feature (278)..(278): n is a, c, g, or t
  modified_base (521)..(521): a, c, t, g, unknown or other
  misc_feature (521)..(521): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaatggtatcagacaagaaaccagggaaacncccctaagctctgatctatgctgcatccagtttgacgtaaacggtcggggtaccagtctaaggttcagtggctaggtggatcgtgggactagtatttcactctcacatacaactagtctagacaactagtaagtattttagacttaacttactactgtacaactagtactttccaccttaccctctctacgtttcggggacgggggttacgtaagggtaggagattacgaacgacgtgtcggnttcgccgttaacgtaac

SEQ ID NO: 347100 - DNA, 524 bp, Homo sapiens
  misc_feature: GZ8MTXP01A2YCP.3.38.D05.1.454.CMB.2.raw
  modified_base (273)..(273): a, c, t, g, unknown or other
  misc_feature (273)..(273): n is a, c, g, or t
  modified_base (524)..(524): a, c, t, g, unknown or other
  misc_feature (524)..(524): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaancccctaaagctcctgatctatgctgcatccagtttgactaaagtcggggtaccagtcgaaggttcaggtggcaagtggatcgtggggacagtatttcactctacaccatacaactagtctgacaacctgaagtattttagactaacttactactgtacaactagtactttccaccttacccctctcctaacgtttcggggcgggggaccaagggtgacgattacgaaacgacttgcggcttcgcaaccgtn

SEQ ID NO: 347101 - DNA, 554 bp, Homo sapiens
  misc_feature: GZ8MTXP01A77ZC.3.38.D05.1.454.CMB.2.raw
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacgcccctaaagctcctgatctatgctgcatccagtttgcaaacgtgggtccatcaaggttcagtggctagtggatcgtggggacagtatttcactctcaccatacaaactagtctagaccaaacctaggtaaagtagtttttagacctaaacctttactaaccttgtactaaacgtaagtacttttaccaccttacccctctcctaaccgtttcggggaccgggggttaccaaggggtggaaggattacgtaaacgacgttgtcgggacttcgtcaaccgtaa

SEQ ID NO: 347102 - DNA, 505 bp, Homo sapiens
  misc_feature: GZ8MTXP01ACIR8.3.38.D05.1.454.CMB.2.raw
  modified_base (445)..(445): a, c, t, g, unknown or other
  misc_feature (445)..(445): n is a, c, g, or t
  modified_base (501)..(501): a, c, t, g, unknown or other
  misc_feature (501)..(501): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaagcccctaaagctcctgatctatgctgcatccagtttgacaaaggtggggtccatcaaggttcagtgcagtggatcgtggggacagtatttcactctacaccatcaacagtctgacaactgaagtattttgactaacttactactgtacaactagtatttccaccttacccctntaactcgtttcggggcggggaccgaagggtgagattacaaacgactgtggcttgcnctaa

SEQ ID NO: 347103 - DNA, 509 bp, Homo sapiens
  misc_feature: GZ8MTXP01DRJ3E.3.38.D05.1.454.CMB.2.raw
  modified_base (476)..(476): a, c, t, g, unknown or other
  misc_feature (476)..(476): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctattaaatggtatcaagcaagaaaccagggaaacgcccctaaagctcctgatctatgctgcatccagtttgcaaagtcggggtccatcaaggttcagtggcagtgatctggggacagatttcactctcacatcaacagtctgcaactgaagtattttgctaaacttactactgtcaacaagtctttcaccttacccctctctacgtttcgggcgggggttaccgaagggtgacgnttacaaacgaacgtgtggcttcgtccaactaac

SEQ ID NO: 347104 - DNA, 583 bp, Homo sapiens
  misc_feature: GZ8MTXP01BZ8VV.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattgtatcagcagaaaccaggaaacgcccctaagctcctgatctatgctgcactccagtttcgactaaaggtcgggggtacccataaccgaaagttcgagtaggcgacgtggtagtcgtgggacgagtattctactctcaaccactactaacacgtactcgactaacctacgtaaaggtattttagtactaaactttaactacttactacgtaaactagtaacgtttactaacccttaacccctccttccgtaccgttcgggttaccgggggaacggttaacgggttagggacgaagtacgtaaacgaacgtagttcggtaacgttgtaacc

SEQ ID NO: 347105 - DNA, 559 bp, Homo sapiens
  misc_feature: GZ8MTXP01ECR94.3.38.D05.1.454.CMB.2.raw
  modified_base (259)..(259): a, c, t, g, unknown or other
  misc_feature (259)..(259): n is a, c, g, or t
  modified_base (395)..(395): a, c, t, g, unknown or other
  misc_feature (395)..(395): n is a, c, g, or t
  modified_base (472)..(472): a, c, t, g, unknown or other
  misc_feature (472)..(472): n is a, c, g, or t
tcagagacgcactccacgaccggtgctcgatttagtatctgatagttgggtttgggggagtcagtctcagtcaggacacagcatgtacatgagggtccccgctcagctcctggggctcctgctactctggctccgaggtgccagatgtgacatccagatgacccagtcctccatccctccctgtctgcatctgtaggagacagagtcaccatcacttgccgggacaagtcagagcattagcagctattaaattggtatnaagcaagaaaccagggaaacgcccctaaagctcctgatctatgctgctatcctagtttgcgtaaagtcggggtaccagtacaaggttcaggtggcaggtggatcgtggggacagtattcactctcaccatacaacngtctgacaacctgaaacgtattttacgacttaaacttactactgtacaaactaaggtactttacaccttaccccttntctacgtttcggggaccgggggttaccaaagggtggaagttacttaacgaaaccggtaaatcggtgggcttacggccttaaccgtaa

SEQ ID NO: 347106 - DNA, 522 bp, Homo sapiens
  misc_feature: GZ8MTXP01D9ODU.3.38.D05.1.454.CMB.2.raw
  modified_base (516)..(516): a, c, t, g, unknown or other
  misc_feature (516)..(516): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaacgcccctaaagctcctgatctatgctgcatccagtttgactaaaggtcggggtaccagtcaaggttcagtggcagtgatcgtgggacagtattcactctacaccatacaactagtctgacaactgaagtattttgactaacttactactgtacaactagtactttaccacctacccctctctaacgtttcggggaccgggggttaccgaaagggtcgaggacttacgaaacgactgtggcttgccncgtaac

SEQ ID NO: 347107 - DNA, 572 bp, Homo sapiens
  misc_feature: GZ8MTXP01C5K6W.3.38.D05.1.454.CMB.2.raw
  modified_base (197)..(197): a, c, t, g, unknown or other
  misc_feature (197)..(197): n is a, c, g, or t
  modified_base (414)..(414): a, c, t, g, unknown or other
  misc_feature (414)..(414): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctcctgtctgcatctgtagganacagagtcaccatcacttgccgggcaagtcagagcattagcagtacttaattaaattggtatcaagacaaagaaaccgaagggaaacgacccctaaagcctcctgactctatgctgctatcctagtttgacgtaaacggtcgggtaccagtactaaggttcaggtggacgtaggtggtagtcgtagggacagtatttcacttcacaccatacaactntcagactaactagtaagttatttacgacttaaacttactactacgtacaagtacgttacttaccacccttacccctctaaccgtacggtttcgggggaccggggttactaaggggtgaacgcttaacgaaacgtacgtggtacgcttacgccaacctg

SEQ ID NO: 347108 - DNA, 515 bp, Homo sapiens
  misc_feature: GZ8MTXP01D9ABC.3.38.D05.1.454.CMB.2.raw
  modified_base (272)..(272): a, c, t, g, unknown or other
  misc_feature (272)..(272): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaancccctaagctctgatctatgctgcatccagtttgcaaagtgggtccatcaaggttcagtggcagtggatcgtgggacagtattcactctcaccatacgaaacagtctgacaacctagaaacgtatttttcgactaaactttactaactgtacaactaagtactttaccacctacccctctaactacgtttcggggcgggggaccaagggtggagattacaaacgactgtggcttgcaacgtaa

SEQ ID NO: 347109 - DNA, 843 bp, Homo sapiens
  misc_feature: GZ8MTXP01A9JF6.3.38.D05.1.454.CMB.2.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagcagaaaccagggaaacncccctaaagctcctgatctatgcttgctatcctagtttcgactaaaacggttcgggggtacccaagtccgtaaagggtttaccaagggttcggggaccgtaaagggtttaggggaacgtttacccgggtttaggggggaaaccgtaaagggttaacgtttttttacccgaaacccgttttcccgttaacccgaaaccccctaaagttttaaccccgaaaaaccttaacggttcccttacggaaaccctaaaccccgtttaaggtaaaaggtttacgtttttttaacggtaaaccctttaaaaccttttaacccgtttaaacccttacgggtttaaaccctaaaacgttaaaccggttaaccggttttttaaccccaaacccccgttttaaaccccccctttccgttaaccccggtttaaacccgggttttttacccggggggaacccgggggggggttaaaccccgaaaagggggtttaagggggaaaccggttaacgttaaaccgggaaaaaccggtaaaccggttgggttacgggggaccttacgggaacccgttaaccgttaaccg

SEQ ID NO: 347110 - DNA, 535 bp, Homo sapiens
  misc_feature: GZ8MTXP01DJJB3.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaacaaaccaggaaacgcccctaagctcctgatctatgctgaactccatttgaccaaaggtgggtacccatcgaaaggttcaaggtggacagtggatcgtggggacagtatttacactactaaccatacgagtcggtctgacaacctagaagtattttcgactaactacactactgtacaaacagtagtagacagaaccacgcctacacgtacgttcgggacggacgggaccgaagggtaggaagactacgaaacgtaacgttggtaacg

SEQ ID NO: 347111 - DNA, 659 bp, Homo sapiens
  misc_feature: GZ8MTXP01B3YM9.3.38.D05.1.454.CMB.2.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (537)..(537): a, c, t, g, unknown or other
  misc_feature (537)..(537): n is a, c, g, or t
  modified_base (644)..(644): a, c, t, g, unknown or other
  misc_feature (644)..(644): n is a, c, g, or t
tcagagacgcactccacgaccggtgctcgatttagtatctgatagttgggtttgggggagtcagtctcagtcaggacacagcatggacatggacgggtccccgctcagctccgtggggctcctgctactctggctccgaggtgccagatgtgacatccagatgacccagtctccatcctccctgtctgcatctgtagganacagagtcacatcacttggccggganaagtcagagcatagcagacttaattaaattggtatcagacaagaaaccgaagggaaacacccctaagcctcgagatctatgctgctatctagtttgacgtaaacggtcgggtaccagtacgtaacggttcaaggtcggacgtagggttaggagttcgaggggtaaacagttactttacaacctctaccaacctataaccaaactagttccacgaacctaaacgttagaaacgtttattttacgaaccttaaactttacttaaactgttaacccaaatacggttaacgtttccccaaacccttacccccgtnttaacccggtaccgggtttcccggggggaaacggggggttacccgtaaaggggttagggaacgttaaccttaaacgggtaaaaccgtacggttggtacgggcttacnccccgttaaatcccg

SEQ ID NO: 347112 - DNA, 528 bp, Homo sapiens
  misc_feature: GZ8MTXP01A6HIS.3.38.D05.1.454.CMB.2.raw
  modified_base (272)..(272): a, c, t, g, unknown or other
  misc_feature (272)..(272): n is a, c, g, or t
  modified_base (353)..(353): a, c, t, g, unknown or other
  misc_feature (353)..(353): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaanccctaagctcctgatctatgctgcatccagtttgcaaacgtcggggtccatcaagttcagtgcagtgatcgagggacagtnttcactctcacatacaactagtctgacaacctgaactagttttcgactaaacttactactcgtacaactagtactttaccaccttacccctctcctaacggtttccgggacgggggaccaaaggggttggacgacttaccgaaacgtacgtaagtcggacttcgtcaaccgtaag

SEQ ID NO: 347113 - DNA, 549 bp, Homo sapiens
  misc_feature: GZ8MTXP01DYTVF.3.38.D05.1.454.CMB.2.raw
  modified_base (485)..(485): a, c, t, g, unknown or other
  misc_feature (485)..(485): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggcaagtcagagcattagcagtacttaattaaattggtatcaagacaaagaaaccgaagggaaacacccctaaagcctctgatctatgctgctattccgtagtttgacgtaaacggtcggggtaccagtcgtaaggttcagtggcagtggatcgtagggactagtactttcacttcacactatacaactgtctcgactaacgtagtaagttactttacgacttaaacttactactgtacaactagttcttaccaccttacccctntaaccgtacggttcggggacggggactaagggtgagttgacaagtactgtggcttgccaacgtc

SEQ ID NO: 347114 - DNA, 514 bp, Homo sapiens
  misc_feature: GZ8MTXP01AQIQC.3.38.D05.1.454.CMB.2.raw
  modified_base (277)..(277): a, c, t, g, unknown or other
  misc_feature (277)..(277): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaatggtatcagcaagaaaccagggaaacncccctaaagctcctgatctatgctgcatccagtttgactaaacggtcggggtccagtcaaggttcagtggcaggtgatcgtgggactagtatttcactctacaccatacaacagtctagacaacctgtaaagtattttgactaacttactactgtacaactagtacttcacctacccctgtctacgttcgggcgggggacagggtgagnttacgaacgactgtggcttcgcncgtaa

SEQ ID NO: 347115 - DNA, 587 bp, Homo sapiens
  misc_feature: GZ8MTXP01ACCO5.3.38.D05.1.454.CMB.2.raw
  modified_base (278)..(278): a, c, t, g, unknown or other
  misc_feature (278)..(278): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaattggtatcagcaagaaaccagggaaacncccctaaagctcctagatctatgctgcatccagtttgactaaacggtcgggtccagtcgaaggttcagtggcaggtgatcgtgggactagtatttcactctacaccatacaactagtctacgacctaaacgtgtaaagtattttcgacttaaacttactaacgttgtacaaacgtacgtactttccaccttacccctacttcgtaacccggtttcgggggaccgggggttaaccgtaaagggttggaacggttaacttaccgaaaaccggtagttcgggttacgggaccttcggaacccttaacgttcg

SEQ ID NO: 347116 - DNA, 599 bp, Homo sapiens
  misc_feature: GZ8MTXP01CZHCJ.3.38.D05.1.454.CMB.2.raw
  modified_base (198)..(198): a, c, t, g, unknown or other
  misc_feature (198)..(198): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccgggacaagtcaagagcattagcagctaataaatggtatcagcagaaaccaggaaacnccctaaagctccngatctatgctgcattccgagtttgactaaaacggttcgggggtaccaagttccgaaagggtttacaggttgggctagtaggatccgtaggggacagtatttcaactctacaccagtacaactagtctagacaacgtagaattatttacgactaaactttacaattcgtacaacgtagtactttaccacccttaccctcgtaactaccggtttacgggggaccgggggttaacctaaaggggtggaacgttcgttaaacccgaaaaggtaacccgtttggtacgggccttacggtcccgaaacccgtttg

SEQ ID NO: 347117 - DNA, 505 bp, Homo sapiens
  misc_feature: GZ8MTXP01CEOAC.3.38.D05.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (313)..(313): a, c, t, g, unknown or other
  misc_feature (313)..(313): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
  modified_base (498)..(499): a, c, t, g, unknown or other
  misc_feature (498)..(499): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgagganacagagtcacatcacttgccgggnaagtcagagcattagcagctaattaaatggtatacagacaagaaaccaagggaaacgcccctaaagcctcctgatctatgctgcatcctagttnacgaaacggtcgggtacatcaagttcaggtgcagtggatcgtagggactagactttcactctcaccatacgaaacngtcngactaactagaatatttnactaatactatcacanagtnttaccactccccgtatcctaagttcgggacggggacaagggtcgagnttacgaaacgatggngtacnncncgtn

SEQ ID NO: 347118 - DNA, 560 bp, Homo sapiens
  misc_feature: GZ8MTXP01AL534.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcagctaatttaaattggtatcagacaagaaaccgagggaaacgcccctaagcctcctagatctatgctgcatcctagtttcgactaaaggtcgggtacccagtaacaaggttcagtggcagtggatcgtgggacagtatttcactctcacatacaacagtcagacaaccgtaggaacgttatttgactaacttactactgtacaactagtacttccacctaaccctcttaccgtaccggtttccggggacgggggtaaccgaagggttcggacgtaactaccgaaacggtaacgtcggttacggtccttcggtaaccc

SEQ ID NO: 347119 - DNA, 602 bp, Homo sapiens
  misc_feature: GZ8MTXP01BWFPY.3.38.D05.1.454.CMB.2.raw
  modified_base (221)..(221): a, c, t, g, unknown or other
  misc_feature (221)..(221): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggnaagtcagagcattagcagtcttaattaaatggtatcagacaagaaaccgaagggaaacgcccctaaagctcctgactctatgctgctatcctagtttgacgtaaacggtcggggtaccagtacgtaaggttcaaggtggctaggtggatcgtagggactagtactttcactctcacatacaactagtctagactaaactagtaacgttattttacgacttaacttactactcgtacaactagtactttccacccttacccctcgtaaccgtaccggtttccgggggaaccggggggaaccgtaaaggggtacgggaacgttaacgttaaccgtaaaaccgtacgtaacggtcggtccttacggtaaccttaaccgttaacc

SEQ ID NO: 347120 - DNA, 694 bp, Homo sapiens
  misc_feature: GZ8MTXP01AWOMV.3.38.D05.1.454.CMB.2.raw
  modified_base (223)..(223): a, c, t, g, unknown or other
  misc_feature (223)..(223): n is a, c, g, or t
  modified_base (278)..(278): a, c, t, g, unknown or other
  misc_feature (278)..(278): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggnaagtcagagcattagcagtcttaattaaattggtatcagcaagaaaccaggaacnccctaagctctgatctatgctgctattcctagtttcgacgtaaacggttcggggtacctaagtacgtaaaggtttcaagggttcgggacgtaagggtcgggtaacgttccgggtacgggggaaactaaggttacttttaccaaaccttcctaaccaacccaattacccaaaactcggtacctacggaaccctaaaccgttagtaaacgtttactttttacgaacctttaaacctttaaccgtaaccttaggtaaccctaaacgtaacggttacttttacccaacccttacccctcgttaacccgttaaccgggtttccgggggaaccgggggttaaaccgaaaggggttacggaacgttacttaaaccggaaaacgtacgttcggtacgggaccttacggtaaccaaccgttaacg

SEQ ID NO: 347121 - DNA, 561 bp, Homo sapiens
  misc_feature: GZ8MTXP01BKSP2.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagtactaattaaattggtatcagacaagaaaccgagggaaacgcccctaaagcctcctgatctatgctgctatcctagtttgacgtaaacggtcggggtaccagtactaaggttcaggtggcaggtggatcgtgggacagtacttcactctcacctatacaactagtctcgacaacctagtaagttattttgactaacttactactgtacaactacgtattcctacctaccccttctccgtaacggtttccggggaccgggggttaccgtaagggtggagacgttacaaacggtacgtaaggtcggcttcggcaacgtaacg

SEQ ID NO: 347122 - DNA, 601 bp, Homo sapiens
  misc_feature: GZ8MTXP01A3YK5.3.38.D05.1.454.CMB.2.raw
  modified_base (276)..(276): a, c, t, g, unknown or other
  misc_feature (276)..(276): n is a, c, g, or t
  modified_base (428)..(428): a, c, t, g, unknown or other
  misc_feature (428)..(428): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcatagcagctaattaaatggtatcagacaagaaaccagggaaacncccctaaagctcctgatctatgctgcatcctagtttcgacgtaaaggtcgggtaccagtccgtaaggttcaagtgggactaggtggactcgtagggactagtactttcactctacactatacaactagtctagactaacgtagtaaacgttnttttacgacttaaacttactactgtacaaactagttactttcccaaccttacccctcgttccgtaaccggttttccgggggaccgggggttaaccgtaaaggggttcggaaacgttacgttaaccgaaaaccggtacgttaacggtcggaccttacggtaaccaacccgttaa

SEQ ID NO: 347123 - DNA, 698 bp, Homo sapiens
  misc_feature: GZ8MTXP01DE7O4.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcaagagcattagcagtcttaattaaattggtatnagacaaagaaaccgaaggaaacncccctaaagctcctagatctatgctgctatcctagtttgacgtaaacggtcggggtaccagttacgtaaggtttacaggttggacgtagggttacgggtagtccgtagggggtaactagttacttttaccaacctttcctacctaaccctaatacccgtaaaactcgttaccgttagacctaaaccgttagtaaaacgtttatttttacgaacttaaacctttaacgttaccttagttaaccctaaacgttaacggttaacctttaccctaaacccctttacccccttcgtaacccgtttacgggtttacccggggggaacccgggggttaaaccgtaaacgggggtggttaaacggacgttaacgtaaaaccggtacgtcggtacgggtcttacgaaccgttaacccgttaacg

SEQ ID NO: 347124 - DNA, 600 bp, Homo sapiens
  misc_feature: GZ8MTXP01BF38L.3.38.D05.1.454.CMB.2.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (355)..(355): a, c, t, g, unknown or other
  misc_feature (355)..(355): n is a, c, g, or t
tcagagacgcactccacgaccggtgctcgatttagtatctgatagttgggtttgggggagtcagtctcagtcaggacacagcatggacatgagggtccccgctcagctcctggtgctcctgctactctggctccgaggtgccagatgtgacatccagatgacccagtctccatcctccctgtctgcatctgtagganacagagtcaccatcacttgccgggcaagtcagagcattagcagctattaaatggtatcagcagaaacaggaaacncccctaagctcctgatctatgctgcatccagtttgacctaaaggtcggggtcccatcaaaaggttcaagtggcagtggatcgngggacagtatttcactctaccacctatacaactagtcctagaccaaaccgttagtaaagggttactttttcgaccttaaacctttaactacctacgttaccaaaccgtagttacgtttaccaacccttaccccttccttcgttaacccgggttttccgggggaccggggggtaaaccgtaagggttacgggagttaacgttaaccgaaaacggtaacgtagggtcgggttcttcggccgtaaccg

SEQ ID NO: 347125 - DNA, 630 bp, Homo sapiens
  misc_feature: GZ8MTXP01DGXPA.3.38.D05.1.454.CMB.2.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgaccccagtcctccatccctccctgtctgcatctgtaganacagagtcaccatcactggccggnaagtcagngcatagacagcttaattaattggtaatcagcaagaaccgaagggaaacncccctaagcctctagatctatgctgctatcctagtttacgacgtaaacggtcgggtaccccagtaaccgtaaagggttcgaagggtcgggacgtagggtgggattcgggtagggtactagttactttcacttcctaccaccctataccaactagttacctacgaactaaccgttagggtaaagttacgttttacgacttaaaccttacctaacttacgtaacctaactaacgttacgtttaccaacccttaacccctcgttaccgtacggtttccggggacgggggtaaccgttaagggttcggaagtaagtaaccgaaacgtacgtggttacggtcttcgtaacc

SEQ ID NO: 347126 - DNA, 664 bp, Homo sapiens
  misc_feature: GZ8MTXP01CGRKA.3.38.D05.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctaattaaatggtatcagcagaaaccagggaacncccctaaagctcctgatctatgctgctatcctagtttgacgtaaacggtcgggggtaccagtccgtaagggtttacaagggttcgggcgtaagggtgggtaacttcggtagggggaactaggttacttttacaaccttctaccaacctactaccaaacgtagttcctcggacctaaaccgttagtaaacgttacttttacggaaccttaaacctttaaccttaccttacgttaccaaacgtacggttaacctttaccaaccctttacccccttcttaacccgttacccgggttttccgggggaccggggggttaacccgtaaaggggttggaacgttacgttacgaaaccggtaacgtcggtacgggtcttcgaaccgttaacccgtaag

SEQ ID NO: 347127 - DNA, 566 bp, Homo sapiens
  misc_feature: GZ8MTXP01AEC5C.3.38.D05.1.454.CMB.2.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
  modified_base (559)..(559): a, c, t, g, unknown or other
  misc_feature (559)..(559): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacgttgccgggcaagtcagagcattgcagtacttaattaaatggtatcagacaaacggaaaccgagggaaaccncccctaagcctcctagacttactatgctgactattcctaggtttcgacgtaaacggtcggggtaccagttacgaaaggttcaggtggactagggtgatcggtgggactaagtctttcacttctacacctatacaactacgtcacgtactaacgtagtaacttagtttcaacttaaccttactaatcgtaacaactagtactttaccacccttccctctcgtacggttcgggacggggttacaggggtagagttacacgaagtatcggcgcttcncgaactg

SEQ ID NO: 347128 - DNA, 552 bp, Homo sapiens
  misc_feature: GZ8MTXP01CXFDH.3.38.D05.1.454.CMB.2.raw
  modified_base (202)..(202): a, c, t, g, unknown or other
  misc_feature (202)..(202): n is a, c, g, or t
  modified_base (284)..(284): a, c, t, g, unknown or other
  misc_feature (284)..(284): n is a, c, g, or t
tcagagacgcactccacgaccggtgctcgatttagtatctgatagttggggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacttgccgggcaagtcagagcattagcagcttaatttaattggtatcagacaagaaaccgagggaaacncccctaagcctcctagatctatgctgcatcagtttcgacgaaaggtgggacccatactaaggtcagtggactaggtgactcgtagggactagtacttacactctacactatcaacagtctagaccaaccgtaggaagtattttcgaactaacttactactgtacaactagtacttcacctaaccctcttccgtacggttccggggacgggggtccttaagggttggacgtaacttacgaaacgtaacgtggttcggtcttcgtaaccg

SEQ ID NO: 347129 - DNA, 552 bp, Homo sapiens
  misc_feature: GZ8MTXP01B3TRL.3.38.D05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (468)..(468): a, c, t, g, unknown or other
  misc_feature (468)..(468): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgggnaagtcagagcattagcagcttaattaaatggtatcagcaagaaacaggaacncccctaagctcctgatctatgctgcatcctagttgactaaacggtcggggtccagtcgaaggttcaggtggacaggtggatcgtaggggactagtatttcaacttctacaccataccaatcgttcngaccaacctgaaacgttagttttnacttaacttactactgtacaacgtagtcttaccacctcccctntccgtaacggttcggggacggggttaccgaagggtgacgttacttacgtaaacgctaaggtcggcttacgaaccttaacgtaac

SEQ ID NO: 347130 - DNA, 556 bp, Homo sapiens
  misc_feature: GZ8MTXP01BO5PU.3.38.D05.1.454.CMB.2.raw
  modified_base (275)..(275): a, c, t, g, unknown or other
  misc_feature (275)..(275): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaattaaattggtatcagcagaaaccagggaacncccctaaagctcctgatctatgctgcatccagtttgactaaacggtcggggtaccatcgaaggttcaggtggcaggtggatcgtagggactagtactttcactctacaccataccaactagtctagacaacctagtaagtagttttgacttaacttactactgtacaaactacgtacgtttaccaccttacccctctccgtacggtttcggggaccgggggttacgtaagggtggagacgttacgaaacgtaagtcgtcgggcttcgtccttaaccgtaac

SEQ ID NO: 347131 - DNA, 630 bp, Homo sapiens
  misc_feature: GZ8MTXP01DMBGZ.3.38.D05.1.454.CMB.2.raw
  modified_base (225)..(225): a, c, t, g, unknown or other
  misc_feature (225)..(225): n is a, c, g, or t
  modified_base (291)..(291): a, c, t, g, unknown or other
  misc_feature (291)..(291): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccggganaagtcagagcattagcagtacttaattaaatggtaatcaagacaaaggaaaccgaaggggaaaccncccctaaagcctacctgatctatgcttagctatcctagtttcgacgtaaacggtcggggtaccagtacgtaaggtcaagtggactaggtggtatcggtaggggactagtactttcactctacactanactaacngtcagactaaactgtaaattaggtttacaaccttaaactttactactgtaaccaaacgtacgttaaccgtttccaacccttaccccgttataacccgtaaccgggtttaccggggggacccgggggttaactaaaggggtcggaacggttacttaaaccggaaacgtaacgtcggttacgggacttacggaaccttcgttaaccg

SEQ ID NO: 347132 - DNA, 716 bp, Homo sapiens
  misc_feature: GZ8MTXP01B3RCP.3.38.D05.1.454.CMB.2.raw
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
  modified_base (578)..(578): a, c, t, g, unknown or other
  misc_feature (578)..(578): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaattaaattggtatcagcaagaaaccagggaaacncccctaagcctctgatctatgctgctatcctagtttcgacgtaaaacggttcgggggtacccaagtaccgtaaagggtttaccgaagggtcgggtacgtaagggttgggaacttcggtagggggaacctaggtacttttccaccttacctacctaacccaattaccctaaaacgtcgttacctacggaaccctaaaccgttagtaaacgtttactttttaacggaacttaaacctttaacttacgttacgtaacctaaacgtaaggtttaaccgtttaccctaaccctttacccccgttnttaacccgttacccgggttttaaccgggggggaccccggggggttaaacgtaaaccggggtggggttaaacgttacgttaaacgtaaaaccgggtaacgttggggttacgggcttacggaacccgttaaccgtttccg

SEQ ID NO: 347133 - DNA, 673 bp, Homo sapiens
  misc_feature: GZ8MTXP01BCKSX.3.38.D05.1.454.CMB.2.raw
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccggnaagtcagagcattagcagcttaattaaatggtatcagacaagaaaccgaggaaacncccctaaagcctacctgaacttctatgacttgactacttcctagtttcgacgtaaacggtcggggtaccaagtacgtaaggtttcgaaggtcggacgtagggtggacgttccggtaggggactagtactttcaacttctaccactataccaactatctacgactaaccgtagtaaagttacgttttacgaacttaaaccttacgtaacttacgtaacctaaacgtaacgttactttaccctaaccctttaacccctcgttaaccggttaacccgggttttaccggggggaccgggggttaaaccgttaaaggggtacggttaaacggttaaccgttaaacggaaaaccggtaacgttgggttaccggacgttaccggtaaccgttaaccgtttaacg

SEQ ID NO: 347134 - DNA, 576 bp, Homo sapiens
  misc_feature: GZ8MTXP01AM92U.3.38.D05.1.454.CMB.2.raw
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcacatcacttgccggnaagtcagagcattagcagcttaattaaattggtatcagacaagaaaccgaggaacncccctaagcctcctagatctatgctgctatccgtagtttcgacgtaaacggttcggggtacctagtaccgtaaggttcaggtggactagggtggactcgtagggactagtactttcactctacaccatacaactgtcctgacctaaccgtagtaacgttattttacgaccttaaactttactactagtaccaagtacgttacttccaacccttacccctctaacgtaccggtttccgggggacgggggttacctaagggtcggagacttacgaaacgtacgtgtcgcttgccaacgtaac

SEQ ID NO: 347135 - DNA, 549 bp, Homo sapiens
  misc_feature: GZ8MTXP01B4SDR.3.38.D05.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaatggtatcagcagaaaccaggaaancccctaagctcctgatctatgctgcatccagtttcgacaaaggtcggggtcccagtactaaggttcaaggtggcagtgggatcgtaggggacagtatttcactctcaaccatacaacagtctagactaaccgtggaaacgtattttcgactaaactttactactcgtacaactaggtactttccaactaacccctcttccgtaacgtttcgggaccgggggtacaacgggttggaacgtaatacgaaacgtaacgtggttacggtcgttgaacc

SEQ ID NO: 347136 - DNA, 535 bp, Homo sapiens
  misc_feature: GZ8MTXP01BGXQO.3.38.D05.1.454.CMB.2.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagcttaatttaaattggtatcagacaagaaacccgagggaaacncccctaagcctcctgatctatgctgctatccgtagtttcgacgtaaaggtcggggtacccagtacgaagttcaggtggcaggtgatcgtagggacagtattcactctacacatcaacntcagacaactggaattntttacgacttaacttactactgtactaactgtactttccacctccctcttccgtacggttcggggacgggggtacagggttggagaactacaacgtactggttacgcttgaacc

SEQ ID NO: 347137 - DNA, 629 bp, Homo sapiens
  misc_feature: GZ8MTXP01A6IK0.3.38.D05.1.454.CMB.2.raw
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagancatagcagcttaattaaattggtatcagacaagaaaccgaagggaaacncccctaagcctcctgactctatgctgctactccgtagtttcgactaaaggtcgggtacccagtaacgaaggttcgaggtggctaggtggactcgtagggactagtactttcacttctacaacctactacaacgtacgtctacgacctaaccgtaggtaaacgttacttttacgaccttaaacttaccttaacgtacgttaaccaacgttacgtaaccgtttccaaccccttaaccccttcgttaccggttaaccggtttccgggggaaccgggggtaacccttaaggggttcggaacgtaacgtaaccgaaacgtcgtaggttacgggtccttaacggtaacccg

SEQ ID NO: 347138 - DNA, 518 bp, Homo sapiens
  misc_feature: GZ8MTXP01DI4O8.3.38.D05.1.454.CMB.2.raw
  modified_base (376)..(376): a, c, t, g, unknown or other
  misc_feature (376)..(376): n is a, c, g, or t
  modified_base (513)..(513): a, c, t, g, unknown or other
  misc_feature (513)..(513): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaacgcccctaaagctcctgatctatgctgcatccagttgcaaagtgggtccatcaaggttcagtgacagtggatctgggacagtatttcactctcaccatacaacngtctgacaacctagaagtattttagctaaactttactactgtcaacagtactttaccacttacccctcttcctacgtttccgggacgggggttaccgaagggtcggagacgttacgaaacgtaactgtggcttcgcncctaa

SEQ ID NO: 347139 - DNA, 561 bp, Homo sapiens
  misc_feature: GZ8MTXP01AYUKT.3.38.D05.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (535)..(535): a, c, t, g, unknown or other
  misc_feature (535)..(535): n is a, c, g, or t
  modified_base (561)..(561): a, c, t, g, unknown or other
  misc_feature (561)..(561): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccggnaagtcagagcattagcagtacttaattaaattggtaatcagacaagaaaccgaagggaaacncccctaagcctcctagatctatcgctgctactcctagtttgacgtaaacgggtcgggtaccagtacgtaaggttcaggtggactaggtgggactcgtaggggactagttactttaccacttctacaacctataccaactcgtctagacctaaactgtaacgttattttacgactaactttactactacgtacaactacgtacttaccacctaccctctaacgtcggttcggggacggggacagggtgacgnacgaagtatcggcgcttgccaacgtn

SEQ ID NO: 347140 - DNA, 556 bp, Homo sapiens
  misc_feature: GZ8MTXP01DO225.3.38.D05.1.454.CMB.2.raw
  modified_base (374)..(374): a, c, t, g, unknown or other
  misc_feature (374)..(374): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggacaagtcagagcattagcagtctaattaaatggtatcagacaagaaaccgagggaaacgcccctaaagctcctgatctatgctgctatcctagtttgacgtaaaggtcggggtaccagtacgaaggttcagtggcaggtggatcgtgggacngtatttcactcacacatcaactgtctagacaacgtagtagttatttacgactaaactttactatacgtacaactagtactttccaccttacccctcttccgtaacggtttcggggacgggggacgtaagggtggaacgttcgttaaacaaacgtagtggtacgcgttaacgccttaacgtcg

SEQ ID NO: 347141 - DNA, 599 bp, Homo sapiens
  misc_feature: GZ8MTXP01BFS8K.3.38.D05.1.454.CMB.2.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (409)..(409): a, c, t, g, unknown or other
  misc_feature (409)..(409): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (469)..(469): a, c, t, g, unknown or other
  misc_feature (469)..(469): n is a, c, g, or t
  modified_base (489)..(489): a, c, t, g, unknown or other
  misc_feature (489)..(489): n is a, c, g, or t
  modified_base (517)..(517): a, c, t, g, unknown or other
  misc_feature (517)..(517): n is a, c, g, or t
tcagagacgcactccacgaccggtgctcgatttagtatctgatagttgggtttgggggcaggagtcagtctcagtcaggacacagcatggacatggacgggtccccgctcagctccgtggggctcctgctactctggctccgaggtgccagatgtgacatccagatcgaccagtctccatccctcctgtctgctatctggtaagganacagagtccaacctatcacgttcggcccggganaagtcaagacgctagttagctaagtacttaaatttaaagtggtaatcgaagacaaacgaaaaccgaagggaaaccncccctaagccttactagacttctatcgctgactatcgtaagttcgacgtaaaggtcggtacccagtaacgaaggttcgagtcggataggtagntcggtagactagtattcactctacgacctanacaancgtcanactaacgtaggtaacttntttacaacttaacttcactntaaacatacgttactaccaccgttcccngttccgtacgggttcgggggaaccggggtaacagggttgaaacgtaagtaaaccgtaaagtcggtgcgggtaacttcgaacc

SEQ ID NO: 347142 - DNA, 653 bp, Homo sapiens
  misc_feature: GZ8MTXP01EKFGH.3.38.D05.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (286)..(286): a, c, t, g, unknown or other
  misc_feature (286)..(286): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccggganaagtcagagcattagcagcttaatttaaattggtatcagacaagaaaccagggaaacncccctaagctcctgatctatgctgcatcctagtttcgacgtaaaggtcggggtacccagtaccgaaagggtttcaagggtcgggactaagggtggtaatcggttaggggaacctagttactttccaacttcctacaaacccctattaccaaaacgtcgttacctacggaacctaaacccgttaggggtaaagtttactttttacgaaccttaaacctttactaaccttggtaacctaaacgtaggtaacctttcccaacccttaaccccttcttaccgtaccggtttccgggggaccgggggtaacccttaagggggttcgaaggtaactaccgaaacggtacgtggttacgtaacgttcgaacccg

SEQ ID NO: 347143 - DNA, 564 bp, Homo sapiens
  misc_feature: GZ8MTXP01CLCJZ.3.38.D05.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
  modified_base (402)..(402): a, c, t, g, unknown or other
  misc_feature (402)..(402): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggganaagtcagagcattagcagtacttaattaaattggtatcaagacgaagaaaccgagggaaacncccctaaagcctctagactctatgctgctactccgtagtttcgacgtaaacggttcggggtaccagtacgaaggttcaggcgacgtaggtggactcgaggggactaggtactttacnctacactatacagccacgcctgacacgccgtagtacgttagttattttacgacttaaactttatacctagtaacctaattattattcgtttcttcgtcgttggtacgttcggaaccgaaggacgttaggacgtaatacgaagtactggttcgcgttcgaacc

SEQ ID NO: 347144 - DNA, 691 bp, Homo sapiens
  misc_feature: GZ8MTXP01ELI0J.3.38.D05.1.454.CMB.2.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
tcagagacgcactccacgaccggtgctcgatttagtatctgatagttgggtttgggggcaggagtcagtctcagtcaggacacagcatggacatggagggtccccgctcagctccgtggggctcctgctactctggctccgaggtgccagatgtgacatccagatgacccagtcctccactccctccctgtctgcatctgtagganacagatcaccatcacgttcggccggganaagtcagagctaagttagactagtacttaaatttaaagttggtaatacgagacgaaacggaaaaccgaaacggggaaacctaccccctaaagtcccttacctagtacttactatcgtctgacctacgttccgtagtttacggacgtaaagggtccgggtaccctagtaacgtaaggttcgagggtcggacgtagggtggtacgtcggtagggactagtactttccacttacctacaacctactaaccaacgtagttcctacgtaaccgtaaacgttaggtaaaggtttacttttacgaaccttaaaccttacgtacttagtaacctaacgtacgttaccttaccctacccttaacccctcgttaccggtacgggttaccggggaccgggggtaacgaggggttacggaacgtaacgtaacgtaaacggtacgtcggttacggtcgttaacgtaaccg

SEQ ID NO: 347145 - DNA, 619 bp, Homo sapiens
  misc_feature: GZ8MTXP01BLDHB.3.38.D05.1.454.CMB.2.raw
  modified_base (277)..(277): a, c, t, g, unknown or other
  misc_feature (277)..(277): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggcaagtcagagcattagcagcttaattaaatggtatcagacaagaaaccagggaaacncccctaaagcctcctagatctatgctgctatcctaggtttcgacgtaaacggtcggggtacctagtacgtaaggttacaaggtcggctaagggtcggaagtcgtaggggactagtactttcactctacacatacaactatctacgacaactagtaacgttatttacgacttaaactttactaacgttcgtaactaacgtaacggtactttacccaacttaacccccttcgttaacccgttacggttttccgggggaccggggggttaacctaaggggtcggaagttacgttaacggtaaaacgtacgttaaggtacgggtccgttacgccgttaacctaacg

SEQ ID NO: 347146 - DNA, 738 bp, Homo sapiens
  misc_feature: GZ8MTXP01BLFT9.3.38.D05.1.454.CMB.2.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
tcagagacgcactccacgaccggtgctcgatttagtatctgatagttgggtttgggggcaggagtcagtctcagtcaggacacagcatggacatggagggtccccgctcagctcctggggcctcctgctactctggctccgaggtgccagatgtgacatccagatcgacccagtcctccactccctccctgtctgcatctggtagganacagactccaaccatcacgttcggccggganaagtcagagctatagctagacttaattaaagttgaatcgaagacgaaacgaaaccggaaaggaaaccctaccccctaagcccttaccgtatacgttctaagtcgtctagacctaacgttccgttaaggtttaccggaacggtaaacgggtcgggtaccccaagttaaccgtaaaggttcgaaagtcgggtacgtagggtaggacgtaccggtagggtacctaagttactttacccgacctttacccaccctaaaccctattaaccgaaactccgttactaacgaacgtaaccgttaggggtaaactttacgtttaacaccttaaactttcgtaacttcgtaaacctaacgtaacgtttaaccttacccctaacccttaacccgttcgttaccgggttaccccggtttacggggggaacccgggtaaacgttaacggggttcgaaacgttaacgtaaacccggaaacgttaacggtggaaccggtccttaagtaaccccg

SEQ ID NO: 347147 - DNA, 591 bp, Homo sapiens
  misc_feature: GZ8MTXP01DKR8E.3.38.D05.1.454.CMB.2.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (554)..(554): a, c, t, g, unknown or other
  misc_feature (554)..(554): n is a, c, g, or t
tcagagacgcactccacgaccggtgctcgatttagtatctgatagttgggtttgggggagtcagtctcagtcaggacacagcgtggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcatagcagctatttaaatggtatcagacaagaaaccagggaaacncccctaaagcctcctgatctatgctgcattccagtttgacgtaaaggttcggggtaccccaagtcgaaaggtttcaaagtggcgagtggatcgtaggggacaggtacgttcactctacacctataccaacctagttctacgacctaaacctgtaaacgttacttttcggaaaccttaaactttaaccttacgtagttaaccaaagtagtaacgtttaccacttacgtcccttcccgggtctacggtttcggggcggacgggaaacctagggttacggnggttacgaagaaccgtaagtggtggactcggctaacc

SEQ ID NO: 347148 - DNA, 782 bp, Homo sapiens
  misc_feature: GZ8MTXP01BN42P.3.38.D05.1.454.CMB.2.raw
  modified_base (278)..(278): a, c, t, g, unknown or other
  misc_feature (278)..(278): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaatggtatcagcaagaaaccgagggaaacncccctaagcctcctgactctatgctgctacttcctagtttacgacgtaaacgggttccggggtaccctaagtacgtaaacgggttccaagggttcgggacgtagggttgggtaacgttcggttagggggaacctaaggttactttttaccaaaccctttccaccctaaaccctaacttaaccccgtaaaaccgttacggtttaccctacggtaacccctaaaacccgtttaggtaaaaccgttttagttttttacggaaaccctttaaaaccctttttaaaccgtaacctttacggttaaaccctaaaacgttaaacggttaaccgtttttaccccctaaaccccgtttaaccccccttccgttaacccgtttaaacccggggttttcccggggggggaacccggggggttaaaccctaaagggggtcgggttaaacgttaaccgttaaccgaaaaaccggttacgtcggttacgggacttacggaacccgttaaccgttaacg

SEQ ID NO: 347149 - DNA, 605 bp, Homo sapiens
  misc_feature: GZ8MTXP01EVYLY.3.38.D05.1.454.CMB.2.raw
  modified_base (231)..(231): a, c, t, g, unknown or other
  misc_feature (231)..(231): n is a, c, g, or t
  modified_base (287)..(287): a, c, t, g, unknown or other
  misc_feature (287)..(287): n is a, c, g, or t
  modified_base (597)..(597): a, c, t, g, unknown or other
  misc_feature (597)..(597): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgcatctgaggagacagagtcaccatcacgttggccggganaagtcagagcatagcagcttaatttaatggtatcagacaagaaaccgagggaaacncccctaagctcgtatactctagtcgctgacctatcctaggtttaccgaacggtaaaggtcggggtacccaagtaaccgtaagggttcaggtgacgtaggtggtatcgtagggactagtacttacactctactaacactacaacgagtctacaaccgtaactaaggtaagtttacgtttacacctaaacttacctactacgtaacaacgtagtacttacccacccgtaacccttcgttccgtacgggtttaccggggacgggggtaacagggttgaacgtaacgtaaacgtaaacgtacgtggacgtccgngtaacccg

SEQ ID NO: 347150 - DNA, 696 bp, Homo sapiens
  misc_feature: GZ8MTXP01B9PSN.3.38.D05.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagagacgcactccacgaccggtgctcgatttagtatctgatagttgggtttgggggagtcagtctcagtcaggacacagcatggacatgagggtccccgctcagcctccgtggggctcctgctactctggctccgaggtgccagatgtgacatccagatcgacccagtcctccatccctccctgtctgcatctgtagganacagatcaccatcacgttgccggganaagtcagagcatagctagtacttaattaaagtgtatcagacaacgaaaccgaagggaaccacccctaagcctcctagacttctatcgctcgctacttccgtagtttgacgtaaacggtcgggtaccagtacgaaggttcagggtgactagggtgagtcggtagggactacgtactttacacttacctaccaacctactaaccctaaacgtacgttaccgtaccgaaacctaaaccgttaagtaaacgtttacgttttaacgtaacctttaaacctttaaccgttaaccgttacgttaaacctaaaccgttaacggttaaccttttacccctaaccccgtttacccccttccgttaacccggttaacccgggtttaccgggggaccgggggttaaaccgtaaaggggtcggaaacgttacgttaaccgtaaacgtcgtaagtacggcttacgtaaccgttaacttaacg

SEQ ID NO: 347151 - DNA, 559 bp, Homo sapiens
  misc_feature: GZ8MTXP01A28TZ.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagtcttaattaaattggtatcagacaagaaaccagggaaacncccctaagcctcctgatctatgctgcatcctagtttagactaaacggtcggggtaccagtcaaggttcaggtggctaggtgatcgtaggggacagtatttcactctcacctatacgaactagtcagactaaaccgtgtaaagttactttacgacttaacttactatagtaccaactagtacttaccaccttcccctcttaacgtacgtttcgggggaccggggttaaccaaggggtgacgttacttacgaaagtacgtggtagcttacgcgttaacctg

SEQ ID NO: 347152 - DNA, 587 bp, Homo sapiens
  misc_feature: GZ8MTXP01DQ1XI.3.38.D05.1.454.CMB.2.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (520)..(520): a, c, t, g, unknown or other
  misc_feature (520)..(520): n is a, c, g, or t
tcagagacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaaccatcacttggccgggnaagtcaagagcattagcagctaattaaatggtatcancaagaaaccaagggaaacgcccctaaagcctacctagacttcgtatcgcttgactaattccaagttttcgactaaaaggtggggtacccctaagtaaccgtaaagggtttcaaaggttgggaccgtaggttagggatacgtggggactagtaactttcactcttacaacctatacaaacagttccagacaacctggaaagttatttacgactaaaccttagtacctatactaacagtacttccactaaccccgttnttcgtacggttcggggacgggtacgaggttgaacgtaataacaaacgtacgtgttacgtcgttgccg

SEQ ID NO: 347153 - DNA, 862 bp, Homo sapiens
  misc_feature: GZ8MTXP01CG7IG.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaagcccctaaagctcctgatctatgctgcatcctagtttgacgtaaaacggttcgggggtaccctaagttccgaaaggggtttaccaaagggtttggggaccgtaagggtttacggggtaacgttccggttaggggggaacctaagggttaactttttccgaaaccctttaccgttaccctaacccctaaacgttaccctaaaaccgtacggtttacccgttacggtaaccctaaaaccccgttagggtaaaaccggttttaagttttttacggtaccgtttaaaaaccctttttaacccgtttaaaccgtttaccgggttaaacccctaaaaccgttaaaccgggttaaccggttttttaacccctaaacccccgttttaacccccccctttacccggtttaaccccgtttaaaccccgggtttttttcccggggggggaaaccccgggggggggggttaaaccccgtaaaaggggggttcgggggttaaaaccgggttaaaccgttaaacccggtaaaaacccggggtaaaaccgtttcggggttaacggggtcccgtttacgggaaccccttaaacccggtttaacccg

SEQ ID NO: 347154 - DNA, 658 bp, Homo sapiens
  misc_feature: GZ8MTXP01BG7JE.3.38.D05.1.454.CMB.2.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagacagaaccgagggaacncccctaagctcngatctatgctgcattccgagtttcgacgtaaacggttcgggggtacctagtacgtaaggtttaccaggtcggcgaggttgggatcgtaggggactagtatttcacctctactaccattaccaacgtaacgttcctacgaccctaaaccgttagtaaagttacgtttttacggaccttaaaccgtttaccttaaccgttacgttaccaaacgtaacggttacgttttacccctaaccttaccccccgttacttcccgttaacgggttttccgggggaccggggggttaaccctaaagggggtcgttaaacggttacgttaacccggaaacgtaaccgttcgggttcggacgttacggaaccgttaacccttgg

SEQ ID NO: 347155 - DNA, 558 bp, Homo sapiens
  misc_feature: GZ8MTXP01DJDVI.3.38.D05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
  modified_base (412)..(412): a, c, t, g, unknown or other
  misc_feature (412)..(412): n is a, c, g, or t
  modified_base (483)..(483): a, c, t, g, unknown or other
  misc_feature (483)..(483): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcaccatcacttgccgggnaagtcagagcattagcagtacttaattaaagtggtatcaagacaaacgaaaaccgagggaaaccncccctaagcctacctgatctatgctgctattcctagttgacgtaaacggtcgggtaccagtacgaaggttcaaggtggactaggtgatcgagggacagtacttcactcacacatacactgtacnactaactagtaagttagtttacgacttaacttacactacgtacaacgtacgtacttaccaccttacccctntaaccgtcggttcggggacgggaaccgtaagggtgaacgattaacgaaacgtacgtggtcgcttacgccaacgtc

SEQ ID NO: 347156 - DNA, 551 bp, Homo sapiens
  misc_feature: GZ8MTXP01BML0C.3.38.D05.1.454.CMB.2.raw
  modified_base (285)..(285): a, c, t, g, unknown or other
  misc_feature (285)..(285): n is a, c, g, or t
  modified_base (522)..(522): a, c, t, g, unknown or other
  misc_feature (522)..(522): n is a, c, g, or t
  modified_base (547)..(547): a, c, t, g, unknown or other
  misc_feature (547)..(547): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtccaccatcacgttgccgggcaagtcagagcattagcagtacttaattaaatggtatcagacaaagaaaccgaggaaacncccctaagcctctgactctatgctgctatccgtagttcgacgtaaacggtcgggtaccagtcgaaggttcaggtggactaggtggatcgagggactagtattcactctacacatacactacgtctacgactaactagtaacttagtttacacttaacttactactcgtaacctaatacgtacttacctaccttaccctctaacgtcggttcggggacggggttacaagggtgaacgnttaccgaacggatggacgcttgccncgtc

SEQ ID NO: 347157 - DNA, 608 bp, Homo sapiens
  misc_feature: GZ8MTXP01ASS9I.3.38.D05.1.454.CMB.2.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
tcagagacgcactccacgaccggtgctcgatttagtatctgatagttgggtttgggggcaggagtcagtctcagtcaggacacagcatggacatgacgggtccccgctcagctcctggggctcctgctactctggctccgaggtgccagatgtgacatccagatgacccagtctccatccctccctgtctgcatctgtagganacagagtcaccatcacgttcgccggganaagtcagagcattagcagacttaattaagttggtaatcagacaaacgaaaaccgaagggaaaccgcccctaaagccttacctagtacttactatcggctcgactatcctagtttcgacgtaaggtcggtacccagtaacgaaggttcagtgctaggtgatcgtagggactagtacttcgactcctaccaactactaccaacgtagttaccagacctaaacgttaggaacgttattttacaaccttaaacttacgtacgttacgtaactacgtagttactttacccaccttaaccctcgttcgtaccggttcgggggaccgggtaacgttaggcgaacgtaactaacgaaacgtacgtcggttacggtcttcgtaacc

SEQ ID NO: 347158 - DNA, 588 bp, Homo sapiens
  misc_feature: GZ8MTXP01CJG0O.3.38.D05.1.454.CMB.2.raw
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (588)..(588): a, c, t, g, unknown or other
  misc_feature (588)..(588): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggnaagtcagagcattagcagtcttaattaaattggtatcagacaaagaaaccgagggaaacnccccgtaaagcctcctgattctatgtctgctatccgtagttgaacgtaacggtcgggtaccatacgaaggttcaggtgactaggtggtatcggtagggactagtactttcactctacacatacgaactgtctagactaacgtagtaagttactttcgaaccttaacttactacgtctaaccaagtacgttacttacctacccttaccctctaaccggttaccgggttcggggaccgggggaacgtagggtacggaagttacgttaaccgaaacggtacgtggtacggcttacgaaccaaccgttn

SEQ ID NO: 347159 - DNA, 622 bp, Homo sapiens
  misc_feature: GZ8MTXP01D4ZLA.3.38.D05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (306)..(306): a, c, t, g, unknown or other
  misc_feature (306)..(306): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcaccatcacttgccgggnaagtcagagcattagcagcttaattaaattggtatcaagcaaagaaaccgaagggaaacnccccctaaagctcctgatctangctgcatcctagtttgacgtaaacggtcggggtaccagtcgaaggttcaggtggcaggtggatcgtagggacagtactttcactctacaccatacaactagtctagaccaacgtgtaaagttacttttcgacttaaacctttacttactacgtactaaacgtacgttactttccctaaccttaccccctcttaacccgttaaccggttttccgggggaacccggggggttaacccgtaaaggggttacggaacggttaacttaccgaaaacggtaccgtaaggtcgggtaccttacggtaacccaaccgtttaacg

SEQ ID NO: 347160 - DNA, 643 bp, Homo sapiens
  misc_feature: GZ8MTXP01CM1FY.3.38.D05.1.454.CMB.2.raw
tcagagacgcactccacgaccggtgctcgatttagtatctgatagttgggtttgggggagtcagtctcagtcaggacacagcatggacatggagggtccccgctcagctcctggggctcctgctactctggctccgaggtgccagatgtgacatccagatcgacccagtcctccatcctccctgtctgcatctgtaggagacagagtcaccatcacttggccgggacaagtcagagcattagcagtacttaattaaattggtatcaagacaaacgaaaaccgaagggaaacacccctaaagcctacctagactctatcgctgctattccgtagtttacgacgtaaacggtcggggtacctaagtacgtaaaggttacgaagggttcgggacgtagggtaggtagtcggtagggactagtactttcacttctacacctaatacaacgtagtctacgacctaaactaggtaaattattttacgaacttaaaccttactaactgtaacctaagtaacgtactttacccacccttacccctcgtaaccggttacggttaccgggggacgggggaaccgtaaaggggtcggaaagttacttaaccgtaaacggtacgtggttacggcttacggtaaccaaccgttaag

SEQ ID NO: 347161 - DNA, 588 bp, Homo sapiens
  misc_feature: GZ8MTXP01BTXTC.3.38.D05.1.454.CMB.2.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcaccatcacttgccgggnaagtcagagcattagcagtacttaattaaattggtatacaagacaagaaaccgaaggaaacgacccctaaagcctctgatctatgctgcattcctagtttgacgtaaacgtcggggtaccagtacgtaaggttacagtggctagggtggatcgtagggactagtactttcgactctacacctatacaactagtcctagacctaacctagtaacgttatttacgactaactttactactcgtactaacacgttacgttcctaccttacccctctccgtacgtttcggggaccgggggttacgtaagggtggaacgttcgttaacgaaacggtacgtcggttcgggcttacggccttccgttaacg

SEQ ID NO: 347162 - DNA, 586 bp, Homo sapiens
  misc_feature: GZ8MTXP01CDYHC.3.38.D05.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
tcagagacgcactccacgaccggtgctcgatttagtatctgatagttggggtttgggggagtcagtctcagtcaggacacagcatggacatgagggtccccgctcagctcctggggctcctgctactctggctccgaggtgccagatgtgacatccagatgacccagtctccatcctccctgtcctgcatctgtagganacagagtcaccatcacttggccgggnaagtcagagcattagcagtcttaattaaatggtatcgagacaagaaaccgagggaaacncccctaagcctcctgactctagtcgcttgctacttccgtagtttcgacgtaaacggttcggggtaccagtacgtaaggttcaggtcggcaggtggatcgagggtacngtacttacacttcacacatacancgtctgacactagtaacgttatttgacttaacttactagtcgtacaactacgtacgtttcccacccttacccccgtgttaacccggtttccggggaccgggggtaacaaggggttacgacgttaacgttaccgaaacgtaacgttggtcggactcggacctaacttgttccg

SEQ ID NO: 347163 - DNA, 590 bp, Homo sapiens
  misc_feature: GZ8MTXP01ESGB5.3.38.D05.1.454.CMB.2.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (565)..(565): a, c, t, g, unknown or other
  misc_feature (565)..(565): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagatcaccatcacttgccgggnaagtcagagcattagcagtcttaattaaatggtatcaagacaagaaaccgagggaaacncccctaagcctctgatctangctgctatcctagtttcgacgtaaacggtcgggtaccagttacgaaggttcagtgactaggtgatcgtagggactagtacttcactctacacctatacaactagtctagactaactagtaaattacggtttacacttaaacttactactagtaactaacgtacgtactttaccacccttaaccccttgtaacgtaccggtttcgggggaccggggttaaccgtaaagggtcggaacgttacgaaccgtaaaggacgttaacggnggtacgttcgtaaccttcccgtaag

SEQ ID NO: 347164 - DNA, 625 bp, Homo sapiens
  misc_feature: GZ8MTXP01DJRBF.3.38.D05.1.454.CMB.2.raw
  modified_base (219)..(219): a, c, t, g, unknown or other
  misc_feature (219)..(219): n is a, c, g, or t
  modified_base (221)..(222): a, c, t, g, unknown or other
  misc_feature (221)..(222): n is a, c, g, or t
  modified_base (226)..(227): a, c, t, g, unknown or other
  misc_feature (226)..(227): n is a, c, g, or t
  modified_base (231)..(232): a, c, t, g, unknown or other
  misc_feature (231)..(232): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagagacagatcaccatcacttgccgganannagannatannatataataatgtanananacaaacgaaacgaaggaacacctaagctactanatctatgctnactactactagttgaacgtaacggtcggtacagtacgtaagtacgagtgngtagtgtagtcgtaggactagtacttacgtactacctacaactaactaacaaactacgtactacgaactaaacgtagtaaagtttacgtttacgtaaccttaaacctttaactaacgttacgtaactaaacgtaacgttaaccgtttaccctaacccttacccctccttaaccgttaaccgggttacgggggaaccgggggaaaccgtaaagggtacggaaacgttacgttaaaccgaaacgtacgtaacggtacgacgttacgtaaccgttaaccgtaacg

SEQ ID NO: 347165 - DNA, 674 bp, Homo sapiens
  misc_feature: GZ8MTXP01CYBMS.3.38.D05.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (562)..(562): a, c, t, g, unknown or other
  misc_feature (562)..(562): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggcaagtcagagcattagcagtcttaattaaattggtatcagacaagaaaccgaggaaacncccctaaagcctcctgatctatcgctgctactccgtagtttgacgtaaacggttcggggtacctagtacgtaaggtttacaggtggacgtagggttggaacgttcgaggggtactaaggttacttttaccaccttacctaccaaccttaactaccgtaaacgtacgttccttacggaccctaaaccgttagggttaaactttacgttttttacgaacctttaaaacctttacgtaacttacgtaaccaagtttaacgtacgtttacccacccttacccccttnttaacccggttaccggtttaccgggggaccgggggttaacctaaaggggttcggaaagaccgttaaccgaaaacggtaacgtcggttacgcgttacgaaccttccgttaacg

SEQ ID NO: 347166 - DNA, 570 bp, Homo sapiens
  misc_feature: GZ8MTXP01BKMEE.3.38.D05.1.454.CMB.2.raw
  modified_base (408)..(408): a, c, t, g, unknown or other
  misc_feature (408)..(408): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaattaaattggtatcagacaagaaaccgaagggaaacgacccctaagcctcctagatctatgctgctatcctagtttcgacgtaaaggtcggggtaccccagtacgaaggttcaggtcggcagtggactcgtgggactagtattcactctcacatacaacngtctgactaactaggtaattatttcgactaacttactacgttcgtaacaactacgtacttacctacctaacccctcttccgtacgtttccgggggaccgggggtaacgaagggttcggaacgtaagtaacgaaacgtaacgtggttacggtcgttcggaacc

SEQ ID NO: 347167 - DNA, 680 bp, Homo sapiens
  misc_feature: GZ8MTXP01AJFV1.3.38.D05.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatcacttcgccggganaagtcaganctatagctagtcttaattaaagtgtatacagacaacgaaaccgagggaactcccctaagcctctagatctagtcnctgctatcctaggttcgacgtaacggtcgggtaccagtacgtaggttcagggtcggacgtagggtacggtagtcggtacggggaaactaggttacttttaccaccttacctacctaacctaacttaaccgaaacgttcgttaccgtacggtaacccttaaaccgttgttaaacgttacgtttttaacggaacctttaaacgtttaccttacgtaacgtactaaacgtacggttaactttccccaacccttaccccgttcttaaccggttaccgggttcccgggggaacggggttaaaccgtaaggggacggaacgttacgttaccgaaaacggttcggtggtaccggtcttacggtaacccttaacgtttaacg

SEQ ID NO: 347168 - DNA, 686 bp, Homo sapiens
  misc_feature: GZ8MTXP01EGKLM.3.38.D05.1.454.CMB.2.raw
  modified_base (231)..(231): a, c, t, g, unknown or other
  misc_feature (231)..(231): n is a, c, g, or t
  modified_base (679)..(679): a, c, t, g, unknown or other
  misc_feature (679)..(679): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccactccctcccctgtctgctatctgtaggagacagacgtcaccatcacgttggccggganaagtcagagacatagcagtacttaattaaagtggtatcgaacggacaaacggaaaacccgaaggggtaaaccgacccccttaaaggacccttaccgtagtaacttaccttaagtcgacctttagactacgttccgtaaggtttcgaacgtaaacggttccgggtaccaagttaccgtaaaggttccagggtcgggactagggttggaacgtcggtaggggactagttactttcaaccttctaccaactactaacctaaacgtcgttaccgagaacctaaaccgtagtaaaccgtttattttacgaacctttaacttaactacgtacgtactaaacgtaacgttactttacccaccttacccctcgtcgttaacgggtttcggggaccggggttaaccgtaaggggtcgaaacttacgaaacgtaaaccgattggacggcttcgtaacncgtttaa

SEQ ID NO: 347169 - DNA, 817 bp, Homo sapiens
  misc_feature: GZ8MTXP01B1JX7.3.38.D05.1.454.CMB.2.raw
  modified_base (208)..(208): a, c, t, g, unknown or other
  misc_feature (208)..(208): n is a, c, g, or t
  modified_base (237)..(237): a, c, t, g, unknown or other
  misc_feature (237)..(237): n is a, c, g, or t
tcagagacgcactccacgaccggtgctcgatttagtatctgatagttggggtttgggggcaggagtcagtctcagtcaggacacagcatggacatgagggtccccgctcagctccgtggggcctcctgctactctggctccgaggtgccagatgtgacatccagatcgacccagtcctccatccctccctgtctgctatctgtagganacagactcaccatcacgttcggccggganaagtcaagagactattagctaagtacttaaatttaaagttggtaactacgaaacgaaccgaaaacggaaaacccggaaacggggaaaacccgtacccccccgtaaaggtcccttaccccgtagtaactttaccgttaagttcggtaccttacgacctaaccgtttacccggttaacggttttacccggaaaccggttaaaacgggggttcccgggggttaaccccctaaaggtttaaacccgggtaaacgggtttcccgtaaggggtacgggtaccggtaagggtacggggtaacgttcgggtaacggggtaacttaaggttacctttaccaccttaccctaccctaaaccctactaacctaacgtacgttacctacggtaacctaaccgttaaggggtaagtttacgttttacaacctttaaccttacgtacgttagtaacctaacgtagttaccttaccctacccttaaccccgttcttaccggttacccgggttacggggaccgggggtaacgttaacggggttcggaacggtaacgtaaccgaaacggtcgtcgggttacgtcgttaacctaaccg

SEQ ID NO: 347170 - DNA, 682 bp, Homo sapiens
  misc_feature: GZ8MTXP01CO8LI.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatcgacccagtcctccactccctccctgtctgctatcgtaggtaagggagaacgagaacgtaccaaccatcctacgttcggacccgggactaacgtacgaaggtacgactaagttacgactaacgtatttaaagttaaagttggtaactcgaacgaacgaaacggaaaccggaagggtaaaccctacccctaagtccctttacgtacgtaactcgtatcgtccgtgactattaccgtagttcgaacgtaacggtccggtacctagtaacgtaggtacgagtggacgtaggtgtacgtcgagggtactatctttaccacgttacaccactagtactaacgtagtaccgtacgaacgttaactgtaaacgtttattaccgaactttaacgtctacgttacgtaactaaacttacgtcctttaaccctaccgtaccccttagtcccgggttacggggttacgggggacgggttaaccgtaagtcggaaacgttcaaccggtaatacggtgaacgtcgactccgcgttg

SEQ ID NO: 347171 - DNA, 610 bp, Homo sapiens
  misc_feature: GZ8MTXP01DWVAD.3.38.D05.1.454.CMB.2.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctggtagganacagatcaccatcacttggccgggnaagtcagagcattagcagcttaattaaatggtatcagacaagaaaccgaggaaacgcccctaagcctacctagactctatgctgacatcgtagtttcgacgtaaaggtcgggtaccagtacgtaaggttcgaggtgactaggtggatcgtagggactagtacttcacttcacaacctatacaactagtcctacgaactaaccgttaggtaaacgtttacttttacgaaccttaaacttaactacttacgtaactaaactagttacgttaccaaccgttaacccctcttaccgttaccgggtttccggggaacgggggtaacccgaaaggggttcggaaacgtaacgtaaacgaaacgtacgtggttacggtcttaacgtaacc

SEQ ID NO: 347172 - DNA, 670 bp, Homo sapiens
  misc_feature: GZ8MTXP01BJ2F0.3.38.D05.1.454.CMB.2.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccactccctccctgtctgctatctagtagganacagagtcacatcacgttggccgganaagtcagagactagttacgctagtacttaagttaaagttggtaatacgaagaccgaaacggaaaacccggaaggggaaaccctaccccgtaaaggtcccttaccgtagtactacgtatcgtctcgactacttaccgtaggtttcggaacgtaacggtcgggtaccagtacgtacggtacgaggtcggacgtaggtgtacgtcggtagggactagtactttcaacttccacaacctataacccatacgtcacgaactaacgtagtaactttaggtttacaacttacttactacgtctaacaacgttagtcccttaccctaacccctcccgtctaaccgggttacccgggttacggggggaccgggttaaacgtaagggttacggaacgttaacgttacggaaaacgttcggtgggttaccgcgttaccggccttaacccgttg

SEQ ID NO: 347173 - DNA, 509 bp, Homo sapiens
  misc_feature: GZ8MTXP01AW84S.3.38.D05.1.454.CMB.2.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcatagcagctattaatgatcancagaaacaggaaacnccctaagctctgatctatgctgcatcagttgacaaagtgggtcccatcaagtcagtgcagtgatctgggacagattcactctacaccatcaacatcngcaacnggaaanatttgactaacttacacgtntacaaacagactttcaacttaaccccctcttacgtacggttccgggacggggtaaccgaaggttcggaagtaacgaacgtaaacgaacgtacggttacgtcgttcgtcg

SEQ ID NO: 347174 - DNA, 735 bp, Homo sapiens
  misc_feature: GZ8MTXP01E0HM5.3.38.D05.1.454.CMB.2.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccatcacgttgccgggacaagtcagagcattagcagtacttaattaaattggtatcgaagacaaagaaaaccgaagggaaacnccccctaaagtcctcctagatctatgctgcattcctagtttcgacgtaaacggtcggggtacctaagtacgtaaggttaccgagggttgggactagggttacgggacttacggtacgggggaactaacgttactttaccgaccttacctaccaaccctaacttaccgtaaacctacggttacctacggaaccctaaaccgttagtaaacgtttactttttacggaaaccctttaaacctttaacgtttaaccttacgttaacctaaacgttaacggttacttttaccctaaccctttacccccttcgttaacccggttaccgggttttaccgggggaacgggggttaacccgtaaaggggtacgggttaacgttaacgttaaccggtaaacggttaaccggtaaggtttaccggacgttaccgtaacccgttaaccgtttaaccg

SEQ ID NO: 347175 - DNA, 840 bp, Homo sapiens
  misc_feature: GZ8MTXP01EP1WH.3.38.D05.1.454.CMB.2.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
tcagagacgcactccacgaccggtgctcgatttagtatctgatagttgggtttggggggcaggagtcagtctcagtcaggacacagcatggacatgagggtccccgctcagctcctggggctcctgctactctggctccgaggtgccagatgtgacatccagatgacccagtcctccatccctccctgtctgcatctaggtaggagacagagtcaaccatcacttggccgggnaagtcaagngcattagcagctaattaaattggtatcagcaagaaaccgagggaaacgccccaagctccgagtatctatgctgctaatcccagtttcgacgtaaaaggttcgggggtaccctacgtaaaccgtaaagggttcgaagggtagggtccgtaaggttagggtaacgttcggttaacggggggtaaaccctaaggttaactttttaccgaaccttacccttacccgttaaaccccgaaatttaacccgaaaccgttaacgggttaccccttaggtaaacccccttaaaccccgtttagggggttaaaaggttttaactttttttaaccgggaacccttaaaaaccttttaacccgtaaccttttacgggttaaaccctaaaccgttaaacgggtttaccggtttttaaaccccaaaccccggtttaaccccccctttaacggttaccccgttaaacccggggtttttcccgggggggaaacccggggggggttaaaccccggttaaacgggggttaggggttaacggtaaccgggttaaacccgttaaaaaacgggtacccggtttaaggggttcgggttaaccggtttcggtaaacccccg

SEQ ID NO: 347176 - DNA, 608 bp, Homo sapiens
  misc_feature: GZ8MTXP01AMUKY.3.38.D05.1.454.CMB.2.raw
  modified_base (225)..(225): a, c, t, g, unknown or other
  misc_feature (225)..(225): n is a, c, g, or t
  modified_base (467)..(467): a, c, t, g, unknown or other
  misc_feature (467)..(467): n is a, c, g, or t
  modified_base (592)..(592): a, c, t, g, unknown or other
  misc_feature (592)..(592): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagagacagagtcaccatcacgttgccgganagtcagagcattagcagctaattaaatggtatacaagcaagaacgaaggaaacgcccctaagcctccatactctatcgctgtcaacttcgtagtttacgaccgtaaaggtcggggtacccagttaaccaagggtttccaaaggttcgggacgtacggtcgggtaatccgttagggactaagtactttcgaaccttatacaacccattcaaacgtcgttactgaccaacgttgggaaacgttntttacaacttaacttaccattagacctaatcgttaactttcacccggttaaccctgttccgtacgttacgggggaaccggggtacttaaggggttcgaacgtaacgtaaccaacggttaaccggnggttcgtaaccgcgtc

SEQ ID NO: 347177 - DNA, 498 bp, Homo sapiens
  misc_feature: GZ8MTXP02HV87C.3.38.D05.1.454.CMB.2.raw
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaagcccctaaagctcctgatctatgctgcatccagtttgacaaagtggggtcccatcaagttcagtggcagtgatcgtgggacagatttcactctcaccatcaacagtctgacaactagaagtattttgactaactttactacttgtacaactagtactttacactacccctcgtctacgtttcggcggggacaaggtcgagatacgaaagaactgtcgctcgcactac

SEQ ID NO: 347178 - DNA, 643 bp, Homo sapiens
  misc_feature: GZ8MTXP02G96HO.3.38.D05.1.454.CMB.2.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
tcagagacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacgatcccaggatgacccagtcgtccagtcctaccgtgtcctagcatctgtaggagacagagtcaccatcacttgccggganagcagancatagcagtacttaattaagttgtactacagacaacgaaaccgaagggaaaccgtacccctaagcctaccgtagtacttactatcgtctcgactactaccgtacgttacgtacgtaacggtacgggtaccgtacgtacgtaacggttcgtaggtacggtacgtagtaggtagtacgtacggtacgtagtacttactactctactactactacaactacgtactactactaactacgtaagttagtttacgtactaacttaacttactactactaactacgttacttactaccttacccttaccttaccgttaccggttaccgggtaccggggtaccggtaacgggtaacggtaacgtaacgtaacgtaaaccgtaaacgtacggtacggtacgtacgtaccg

SEQ ID NO: 347179 - DNA, 521 bp, Homo sapiens
  misc_feature: GZ8MTXP02HHW2Q.3.38.D05.1.454.CMB.2.raw
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (395)..(395): a, c, t, g, unknown or other
  misc_feature (395)..(395): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaacaggaaancccctaagctcctgatctangctgcatcctagtttgactaaacggtcggggtacccaagtcaaaggtttcaaggtgggctaggtgggatcgtaggggactaggtatttcactctcaccatcaacngtctgacaactgaatatttgactaacttactactcgacaactagtacttcacctacccctctactacgttcggacggggtacaaggtcggacactacgaaaacgtactggtacggctcgcaccgta

SEQ ID NO: 347180 - DNA, 582 bp, Homo sapiens
  misc_feature: GZ8MTXP02IR0KW.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcaagaaaccaggaaacgcccctaagctcctgatctatgctgcatcctagtttcgactaaaggtcggggtacccagtacaaggttcaagtggcagtggatcgtgggacagtatttcactctacactatacaactagtctgacaaaccgtagaaagttattttacgacttaaaccttactacttagtacaaacgtagtaacgtttacaacccttacccctacttacctaccggtttaccgggggaccgggggtaaacccgtaaggggttacggaacgtaacgtaaccgaaaacggtaacgtggtacggactacggaaccc

SEQ ID NO: 347181 - DNA, 582 bp, Homo sapiens
  misc_feature: GZ8MTXP02IRC6V.3.38.D05.1.454.CMB.2.raw
  modified_base (273)..(273): a, c, t, g, unknown or other
  misc_feature (273)..(273): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattgtatcagcagaaaccaggaaancccctaagctcctgatctatgctgctatccagtttgactaaacggtcggggtacccatacgaaggttcagtggcaggtggatcgtgggacagtattcactctacacatacaacagtctgacactagaagtatttgactaactttactactgtacaaactagtacgtttaccaccttacccctcttaccgtaccggttttccgggggaccgggggtaaacccgtaaaggggttcgggaaacgtaacgttaaaccgaaaaaccggtaaccgttacgggttacggaccgttacggacctaaccccgttaacg

SEQ ID NO: 347182 - DNA, 515 bp, Homo sapiens
  misc_feature: GZ8MTXP02J0U9S.3.38.D05.1.454.CMB.2.raw
  modified_base (275)..(275): a, c, t, g, unknown or other
  misc_feature (275)..(275): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaancccctaaagctcctgatctatgctgcatccagtttgcaaagtggggtccatcaaggttcagtgcagtgatctgggacagatttcactctcaccatacaacagtctgacaacctagaaagtatttgactaacttactactagtacaacagtacgttacactacccctctcctacgtttcgggacgggggtaccaagggtacgagaacgtacgaaacgtaacgtgtacggctacgcactacg

SEQ ID NO: 347183 - DNA, 581 bp, Homo sapiens
  misc_feature: GZ8MTXP02IUZK7.3.38.D05.1.454.CMB.2.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaattggtatcagcaagaaaccagggaaancccctaaagctcctgatctatgctgcatcctagtttgactaaaaggtcggggtacccagtcaaggttcaaggtggcaggtggatcgtgggacaggtatttcactctacacctactacaaacagtctgacctaaacctagtaaagtattttagactaaactttacgtaactacgtacaaactagtacgtttaccaacctacccctcttacctaccggtttccggggaccgggggtaaccgtaaacgggtcgggaacgtaacgttacgaaaacggtactaggtcggacgttacggacctacctaacg

SEQ ID NO: 347184 - DNA, 584 bp, Homo sapiens
  misc_feature: GZ8MTXP02F211L.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagcttattaaattggtatcagcaagaaaccaagggaaagacccctaagctcctgatctatgctgcatccagtttgacgaaacggtcggggtacccatacgtaaggttcagtggcaggtaggatcgtagggacagtatttcactctacaccatacaacagtctagacaacctagaaagtatttagactaactttactaactgtacaaactagtaactttaccaaccttaccccctacttacgtaacccggttttccgggggaccggggggaaaccgtaaacggggtcggaaacgtaacgttaacaaaaccggtaacgtggttacggactacggacctaacctaacg

SEQ ID NO: 347185 - DNA, 590 bp, Homo sapiens
  misc_feature: GZ8MTXP02IRXLQ.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccggcaagtcagagcattagcagctatttaaatggtatcagcaagaaccgagggaacgcccctaagctcctgatctatgactgctatccgtagtttgactaaaggtcggggtacccatcgtaagttcagtggcaggtcgatcgtaggacagtatttcactctcactatacaactagtcacgacaacctagaaagttattttacgactaacctttaactaaccttagttaccaaactacggttaactttaccctaaccttaccccgttcttaccgtaccggttttaccgggggacgggggtaaaccctacgggttacggaagtaacgttaacgaaaacgtacgttaggttacggccgttacgtaccaacctacg

SEQ ID NO: 347186 - DNA, 534 bp, Homo sapiens
  misc_feature: GZ8MTXP02HCS0D.3.38.D05.1.454.CMB.2.raw
  modified_base (273)..(273): a, c, t, g, unknown or other
  misc_feature (273)..(273): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaacncccctaaagctcctgatctatgctgcatccagtttgacaaaacggtcggggtaccccaagtacctaaaggtttccaagttggggacaggtggatcgtaggggacagtactttcaacttctacaccaatacaaacagtctcgacaacctagaagtattttagactaacttatactagtacaactagtactttcactaccctctcctacgtttcgggacgggtacaaggtcgacgatacaaacgactagtggactcgcaactc

SEQ ID NO: 347187 - DNA, 571 bp, Homo sapiens
  misc_feature: GZ8MTXP02HX38I.3.38.D05.1.454.CMB.2.raw
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccggcaagtcagagcattagcagctaatttaaatggtatcagcaagaaaccaggaaacncccctaaagctcctgatctatgctgcatcctagtttgacgaaaggtcggggtacccatcgaaggttcagtggcaggtgatcgtgggactagtatttcactctacaccatacaaactagtctagacaacctgtaaagtattttagactaaacttactactgtacaaactagtactttaccaaccttacccccttactaccgtaccggttttccgggggacgggggtaacccgtaaacggggtgggaacgtaacgtaaccgaaaacggtaacgtggtacggctacggcctaaccgtacg

SEQ ID NO: 347188 - DNA, 499 bp, Homo sapiens
  misc_feature: GZ8MTXP02HYTCF.3.38.D05.1.454.CMB.2.raw
  modified_base (271)..(271): a, c, t, g, unknown or other
  misc_feature (271)..(271): n is a, c, g, or t
  modified_base (437)..(437): a, c, t, g, unknown or other
  misc_feature (437)..(437): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaaagctcctgatctatgctgcatccagttgacaaacgtggggtcccatcaaggttcaggtggcagtgatcgtgggacagtattcactctacaccatacaacagtctgacaactgaagtatttgactaacttactactgtacaatagtattacactaccctntctacgtttcggacggggtacacggtagacgtatacgaaacgtactgacgtctacgcactac

SEQ ID NO: 347189 - DNA, 515 bp, Homo sapiens
  misc_feature: GZ8MTXP02GHYGQ.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaagcccctaagctcctgatctatgctgcatccagtttgcaaagtggggtccatcaaggttcagtggcagtggatcgtgggacagtatttcactctcaccatacaacagtctgactaacctgaaacgtatttgactaactttactactagtacaactagagtttaccaccttacccctctacctacgtttcgggaccgggggtaccaagggtcggacgtagtacaaacgactagtcggctcgcactac

SEQ ID NO: 347190 - DNA, 644 bp, Homo sapiens
  misc_feature: GZ8MTXP02HIZM9.3.38.D05.1.454.CMB.2.raw
  modified_base (272)..(272): a, c, t, g, unknown or other
  misc_feature (272)..(272): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaancccctaaagctcctgatctatgctgctatcctagtttgacgtaaaacggtcggggtaccccaattccgtaaagggtttccaagggttcggggctaaggttgggaattcgtagggggaactaggtattttccaacttcctcaacctattacaaaccagttcctacgaccaaacctttaggaaaacgttattttacggtacctaaactttaccttactagttaccaaactaggtactttaccaaccttaccccctcgttacctaccggttttccgggggaccgggggtaaacctaacggggttagggaaacggtaacttaaccgaaaaaccggtaaacgttacggttagggaccttcggacctaaccgttaacg

SEQ ID NO: 347191 - DNA, 543 bp, Homo sapiens
  misc_feature: GZ8MTXP02JCMLE.3.38.D05.1.454.CMB.2.raw
  modified_base (348)..(348): a, c, t, g, unknown or other
  misc_feature (348)..(348): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaagcccctaaagctcctgatctatgctgcatccagtttgacaaagtggggtcccatcgaagttcagtgcagtgatcgngggacagatttcactctcacatacaacagtctcgacaacctgaaacgttatttgacctaactttactactagtacaaacgtagtactttaccaaccttaacccctcttaccgtaccgtttccggggaccgggggtaacccaaggggtacgaagaacgttacaaaacgaacgtggtacggctacgacgacctaacg

SEQ ID NO: 347192 - DNA, 548 bp, Homo sapiens
  misc_feature: GZ8MTXP02F8JAP.3.38.D05.1.454.CMB.2.raw
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (376)..(376): a, c, t, g, unknown or other
  misc_feature (376)..(376): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaancccctaagctccngatctatgctgcatccagtttgcaaagtggggtcccatcaaggttcagtggcagtgatcgtgggacagatttcactctcacatcaacngtctgactaacctgtaaagtattttacgactaacttactactagtacaaactagtaacgtttcaacctacccctcttcctacgtttccggggacgggggtaaaccgaacgggtcgggaacgtacgttaaccgaaaaacgtacgtacggttacggcctacggaccaacctacg

SEQ ID NO: 347193 - DNA, 482 bp, Homo sapiens
  misc_feature: GZ8MTXP02I973Z.3.38.D05.1.454.CMB.2.raw
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaagcccctaaagctcctgatctatgctgcatccagtttgcaaagtggggtccatcaggttcagtgcagtgatctgggacagatttcactctcacatcaacagtctgcaacctgaagtatttgcaacttactactgtcaacagatttcactaccctctcactttcggcgggggtaccaaggtgacgatacaaacgaactgtaggctgcaccta

SEQ ID NO: 347194 - DNA, 505 bp, Homo sapiens
  misc_feature: GZ8MTXP02GSN0R.3.38.D05.1.454.CMB.2.raw
  modified_base (378)..(378): a, c, t, g, unknown or other
  misc_feature (378)..(378): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaagcccctaagctcctgatctatgctgcatccagttgcaaacgtggggtcccatcaaggttcagtggcagtggatcgtgggacaggtatttcactctacacatcaaacngtctgacaacctagaagtattttgactaactttactactgtacaacagtacttcacctaccctctactacgtttcgggcggggaacctagggtcggtagactacaaagactgcggctcggcaccgta

SEQ ID NO: 347195 - DNA, 543 bp, Homo sapiens
  misc_feature: GZ8MTXP02JDBTF.3.38.D05.1.454.CMB.2.raw
  modified_base (227)..(227): a, c, t, g, unknown or other
  misc_feature (227)..(227): n is a, c, g, or t
  modified_base (283)..(283): a, c, t, g, unknown or other
  misc_feature (283)..(283): n is a, c, g, or t
  modified_base (539)..(539): a, c, t, g, unknown or other
  misc_feature (539)..(539): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggnaagtcagagcattagcagcttaatttaaatggtatcagcaagaaaccagggaaacncccctaaagctcctgatctatgctgcatcctagtttcgacgtaaaggtcggggtacccatacgaaggttcagtggcagtggatcgtgggaacagtactttcactctacacctatacaactagtactagacctaaacctgaaagttattttagacttaaacttactactcgtacaactagtactttacacctaccctctacgtacgttcgggacggggacctagggtagacgaatacgaaacgtactaggtcgtacncgac

SEQ ID NO: 347196 - DNA, 499 bp, Homo sapiens
  misc_feature: GZ8MTXP02HIEM5.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaagcccctaaagctcctgatctatgctgcatccagtttgcaaagtggggtcccatcaaggttcagtggcagtggatctgggacagatttcactctcacatcaaacagtctagacaacctagaaagtattttgactaacttactaactgtacaacagtattacacctaccctctcacttcggacgggggtacaagggtgacgatacgaaacgtaactgtacgctgcacta

SEQ ID NO: 347197 - DNA, 562 bp, Homo sapiens
  misc_feature: GZ8MTXP02GQRXP.3.38.D05.1.454.CMB.2.raw
  modified_base (197)..(197): a, c, t, g, unknown or other
  misc_feature (197)..(197): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctatttaaatggtatcagcagaaaccaggaaagcccctaaagctcctgatctatgctgcatccagtttgacaaagtggggtacccatcaaggttcagtggcagtggatcgtgggacagtattcactctcacatcaacagtctgacaacctagaaagtattttgactaaacttactactagttacaaactagtacgtttccaaccttacccctcttacctaccggttttccggggaccgggggtaacctaaaggggttcggaaacgtaacgttaaccgaaaacgtaccgttaggttacgggacttacggacctaaccgtaccg

SEQ ID NO: 347198 - DNA, 589 bp, Homo sapiens
  misc_feature: GZ8MTXP02F3385.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaaattggtatcagcagaaaccagggaaancccctaagctcctgatctatgctgcatccagtttcgacgtaaacggtcggggtccccataccgtaaaggttcaaggtggcaggtggatcgtagggacagtatttcactctacaccatacaactagtctgacaactagaaacgttattttacgactaacctttactactagtacaaacgtagtaacgtttaccaaccttacccctacttaccgtaccggttttcgggggaccgggggtaaaccgaaaggggttacggaaaacgtacgtaaaccgaaaaacgtaccgttaggtacgggacttacggaccacctaacg

SEQ ID NO: 347199 - DNA, 523 bp, Homo sapiens
  misc_feature: GZ8MTXP02IBB0L.3.38.D05.1.454.CMB.2.raw
  modified_base (201)..(201): a, c, t, g, unknown or other
  misc_feature (201)..(201): n is a, c, g, or t
  modified_base (273)..(273): a, c, t, g, unknown or other
  misc_feature (273)..(273): n is a, c, g, or t
  modified_base (497)..(497): a, c, t, g, unknown or other
  misc_feature (497)..(497): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcatgcagctaattaaatgatcagcaagaacaggaaacnccctaagctacctgatctatgctgacatcctagttcgactaaaggtcgggaccatacgaagttcaggttggctagtggatgtagggactagtacttcactctacacctataccaactacgtctagacctaactagaagttattttacgacttaacttactaactagtacaaactagtacttacaccttaccctcttctacgtttcggggacgggtacaggtganaacgtacaaacgtacagtcgctgacc

SEQ ID NO: 347200 - DNA, 499 bp, Homo sapiens
  misc_feature: GZ8MTXP02HX0RM.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaagcccctaagctcctgatctatgctgcatccagtttgcaaaagtggggtcccatcaaaggttcaagtggcagtggatctggggacagatttcactctcacatcaacagtctgcaaacctgaagtatttttgactaaacttactactattcaaacagatttcaactacccctctccactttcggcgggggaccaaggtgagaatcaaaacgactagtggctgacc

SEQ ID NO: 347201 - DNA, 505 bp, Homo sapiens
  misc_feature: GZ8MTXP02FIFMI.3.38.D05.1.454.CMB.2.raw
  modified_base (382)..(382): a, c, t, g, unknown or other
  misc_feature (382)..(382): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcaagaaaccaaggaaagcccctaagctcctgatctatgctgcatcctagtttcgcaaagtggggtccatcaaggttcagtgcagtgatcgtgggacagtatttcactctcaccatcaaacngtctgacaactagaacgtatttgactaacttactactgtacaactagagtttcaactaccctctactacgtttcgggacgggggtaccaaggtcgagaagtacaaaacgtactgtcgctgacc

SEQ ID NO: 347202 - DNA, 539 bp, Homo sapiens
  misc_feature: GZ8MTXP02GN3KI.3.38.D05.1.454.CMB.2.raw
  modified_base (270)..(270): a, c, t, g, unknown or other
  misc_feature (270)..(270): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaccaggaaancccctaagctcctgatctatgctgcatccagtttgacaaagtgggtcccatcaaggttcagtggcagtgatcgtgggacagtattcactctcaccatacaacagtctgacaacctagaacgtatttacgactaacttactactcgtacaactagtactttcaccttacccctctaccgtaccgtttacggggaccgggggtaaccaaaggggtcggaacgtaacgtacgaaaacggtaaccgtggttacggactcggacctacctaacg

SEQ ID NO: 347203 - DNA, 553 bp, Homo sapiens
  misc_feature: GZ8MTXP02G5CJH.3.38.D05.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggcaagtcagagcattagcagctattaaattggtatcagcaagaaccaggaaancccctaaagctcctgatctatgctgcatccagtttgacaaagtcggggtacccagtcaaggttcagtggcagtggatcgtgggacagtatttcactctcacatacaacagtctgacaacctagaaacgtatttagactaaacttactactacgtacaaactagtaactttaccaacctacccctcttaccgtaccgtttacgggggaccgggggtaaccaaagggttcggaacgtaacgtaacgaaaacgtacgtaggtacggactacggaccaactac

SEQ ID NO: 347204 - DNA, 540 bp, Homo sapiens
  misc_feature: GZ8MTXP02HBY9B.3.38.D05.1.454.CMB.2.raw
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
  modified_base (540)..(540): a, c, t, g, unknown or other
  misc_feature (540)..(540): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggacaagtcagagcattagcagctattaaatggtatcagcaagaaccgaggaacncccctaagctccngatctangctgcatcctagtttgactaaacggtcggggtacccagtacgtaaggttcaggtggctaaggtgatcgtagggacagtacttcactctacacatacacngtctgactaactaggaattatttcgactaacttacgtactacgtacaactagtactttaccaccttaccctctacgtacggtttcggggaccgggggtaacaagggtcgagtacgtaacaaacgtactggtacgctcggaccaactn

SEQ ID NO: 347205 - DNA, 530 bp, Homo sapiens
  misc_feature: GZ8MTXP02G1LTF.3.38.D05.1.454.CMB.2.raw
  modified_base (367)..(367): a, c, t, g, unknown or other
  misc_feature (367)..(367): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaagctcctgatctatgctgcatccagtttgacaaagtggggtcccatcaaggttcagcggcagtggatcgtgggacagagtttacnctcacatcagcagcctgcagcctgatgtatttgactaacttattactgtaccaactattaattgtttcttcgttccgttggtaccggtttcggaccgtaacggggaccctaaagggttaggaaaacgttacgaaaacgtaaacgtaggtcggacttacggacc

SEQ ID NO: 347206 - DNA, 534 bp, Homo sapiens
  misc_feature: GZ8MTXP02GREHT.3.38.D05.1.454.CMB.2.raw
  modified_base (445)..(445): a, c, t, g, unknown or other
  misc_feature (445)..(445): n is a, c, g, or t
tcagagacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggcaagtcagagcattagcagctattaaatggtatcagcagaaaccaggaaacgcccctaagctcctgatctatgctgacatccagtttcgacaaagtgggtcccatacaaggttcagtgcagtgatctgggacagtattcactctcacatcaacagtctgacaactgaagtatttgactaacttactaactgtacaaactagtacgttacaaccttaacccctntaccgtaacgtttcgggacgggggtaaccctaaacgggttggaagtaacgtaccgtaaaacgtaaaccgtgtacggaccttggaacccg

SEQ ID NO: 347207 - DNA, 532 bp, Homo sapiens
  misc_feature: GZ8MTXP02GIMY1.3.38.D05.1.454.CMB.2.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggcaagtcagagcattagcagctatttaaatggtatcagcaagaaaccagggaaacncccctaaagcctcctgatctatgctgcatcctagtttgactaaaggtcggggtacccagtctaaggttcaggtggcaggtggatcgtgggacagtatttcactctacacatacaactgtcagaccaactagtaaagtatttcgactaacttactactgttacaagtagtacttacacctccctctcgtacgttcgggacggggtaccagggtcgacgtactaacgaaacgtacgtggtcgcgtcgacctactacg

SEQ ID NO: 347208 - DNA, 534 bp, Homo sapiens
  misc_feature: GZ8MTXP02F72GC.3.38.D05.1.454.CMB.2.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttatttaaatggtatcagcaagaaaccagggaaacncccctaaagctacctgatctatgctgctatccagtttgacgaagtcgggtcccatcgtaaggttcagtggcagtggatcgtagggacagtatttcacttcncacatacaacagtcngacaactagaaagtatttacactaactttacattcacaacagttactttaccaaccttcccccttgcgttacggtttcggggaccgggggaactagggtcggaatataaccgaaaacgtacgtgtacggcacgaccaccta

SEQ ID NO: 347209 - DNA, 533 bp, Homo sapiens
  misc_feature: GZ8MTXP02GC1MC.3.38.D05.1.454.CMB.2.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (466)..(466): a, c, t, g, unknown or other
  misc_feature (466)..(466): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcatagcagctattaaatgtatnagcagaaaccaggaaacncccctaaagctctgatctatgctgcatccagtttgactaaacggtggggtaccccaatcgtaaggttccaaggttcgggctaaggtggatcgnggggacagtatttcactctacactatacaaacngtctgaccaacgtgaaagtattttcgactaaacttactatcgtacaaactagtactttccactacccctntactacgtttcggggacggggtacaaggtcgaagactacgaaaacgaacttgacggctcgacaccta

SEQ ID NO: 347210 - DNA, 603 bp, Homo sapiens
  misc_feature: GZ8MTXP02JSVW4.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (272)..(272): a, c, t, g, unknown or other
  misc_feature (272)..(272): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccggnaagtcagagcattagcagctatttaatggtatcagcaagaaaccaggaancccctaagctcctgatctatgctgcatcctagtttcgacgtaaacggtcggggtaccctagtacgtaaggttcgaaggttgggacgtagggtaggtatccgtaggggacctaaggtactttcaaccttctaccaacccattacaaaccgtagttacctcgtacctaaccgttagaaagtttagttttacgacttaaacctttacttacgttacgtacctaaactagtactttaccacccttacccctcttacgtaccggtttcgggaccgggggtaaccagggttacgacgtacgtacaaacgtacgtacggtacgcgtacgaccactacg

SEQ ID NO: 347211 - DNA, 534 bp, Homo sapiens
  misc_feature: GZ8MTXP02IP8D4.3.38.D05.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggnaagtcagagcattagcagacttattaaattggtatcagacaagaaaccgagggaaacgcccctaagcctacctgatctatgctgcatcctagtttcgacgtaaaggtcgggtaccatacgaagttcgagtggcagtgatcgtagggactagtattcacttctacacatacaactagttcagaccaaacctgaaacgttntttacgactaaacttactactagtacaanagttactacacctacctctctacgtttcgggacggggtacagggtcgaagaacgtacgaaacgtacgtgtcggctacgacc

SEQ ID NO: 347212 - DNA, 514 bp, Homo sapiens
  misc_feature: GZ8MTXP02F3GJF.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaaatgtatcancagaaaccaggaancccctaagctcctgatctatgctgctatccagtttcgactaaacggtcggggtacccagtcaaggttcaaggtggacaggtggatcgtgggacagtatttcactcacaccatacacagtctgacacctagaactatttcgactaacttactactactacacagtactttcacctccctctctacgtttcgggacggggtaccgaggtcgaacgcgtaacaacgtactgtacggctacgcaccta

SEQ ID NO: 347213 - DNA, 571 bp, Homo sapiens
  misc_feature: GZ8MTXP02JRBTQ.3.38.D05.1.454.CMB.2.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgggnaagtcagagcatagcagctaatttaaatgtatcagcaagaaccagggaaacncccctaagcctctgatctatgctgcatcctagtttgactaaacggtcgggtacccagtacgtaaggttcaggtggactaggtgatcgtagggactagtattcaactcctacacctatacaactagtctagacctaacctagaaagttatttacgactaaacttactactgtacaaacgtagtacttaccaccttacccctcttaccgtaccggtttacggggaccgggggtaacctaagggtcggaaacgtacttaaaccgaaaacgtaacgtggtacggtactacgacctacgtacg

SEQ ID NO: 347214 - DNA, 624 bp, Homo sapiens
  misc_feature: GZ8MTXP02IVLXI.3.38.D05.1.454.CMB.2.raw
  modified_base (282)..(282): a, c, t, g, unknown or other
  misc_feature (282)..(282): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggcaagtcagagcattagctagtcttaatttaaatggtatcagacaagaaaccgaaggaaacncccctaaagcctacctagtatctatcgctgctactccgtagttcgacgtaacggtcggtaccagtacgtaaggttcaggtgactaggtgtatcgtaggactagtactttcacctactaccaacctatacaacgtgtactacgacctaaacgttagtaaagtttcgtttacgaacttaaacctttacgtaactacgtaacctaacgttacgtaacctttaccaacccctttaccccgtcgtttaccggtaccgggtttaccgggggaccggggtaaactaaggggttcgaaaacgtacgtaaaccgaaaacggtcgtcggtacggactacgacctacgttacg

SEQ ID NO: 347215 - DNA, 601 bp, Homo sapiens
  misc_feature: GZ8MTXP02IV3I8.3.38.D05.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaattggtatcagcagaaaccaggaaancccctaaagctcctgatctatgctgacnctcctagtttcgacaaaggtcggggtacccagtacgaaaggttccaggtggactagtcggatcgtaggggaccaggtatttaccacttctacacctataccaaactacgtctacgacctaaaccgtagaaagttattttcggaacctaactttaaccttaacgtcgtaaccaacgtagtacttttaccaaccttacccctcttaccgtaccggtttcgggggacccgggggtaccgtaaggggtacggacgtaacgttaccgaaaacgtaaacgttggtacggtctacggaccaacctac

SEQ ID NO: 347216 - DNA, 514 bp, Homo sapiens
  misc_feature: GZ8MTXP02GE2PT.3.38.D05.1.454.CMB.2.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (382)..(382): a, c, t, g, unknown or other
  misc_feature (382)..(382): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
  modified_base (481)..(481): a, c, t, g, unknown or other
  misc_feature (481)..(481): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaaggtcagagcattagnagctattaaattggtatcagcagaaaccaggaaacncccctaaagctcctgatctatgctgcatccagtttgacaaagtcggggtcccatcaaggttcagtggcagtggatgtagggactagtattcactctacacatcaacngtctgacaacctgtaagtatttagactaacttactactntacacagttacttcacctacccnctacgtacgttcgggacggggtaccaaggtcgaacgntaacaaacgtactggtacggctacgacactacg

SEQ ID NO: 347217 - DNA, 537 bp, Homo sapiens
  misc_feature: GZ8MTXP02GYQNA.3.38.D05.1.454.CMB.2.raw
  modified_base (275)..(275): a, c, t, g, unknown or other
  misc_feature (275)..(275): n is a, c, g, or t
  modified_base (385)..(385): a, c, t, g, unknown or other
  misc_feature (385)..(385): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaancccctaaagctcctgatctatgctgcatccagtttgcaaagtggggtcccatcaaggttcagtggcagtggatctgggacagatttcactctcaccatcaaacagtctanacaactagaaagtatttagtactaaacttactactacgtacaaactagtactttacctaaccttaccctctaccgtacggttcggggacgggggtaacgaacgggtacgacgaataacgaaaacgtaacgtacggtacgcgtacgacactac

SEQ ID NO: 347218 - DNA, 541 bp, Homo sapiens
  misc_feature: GZ8MTXP02GFOQS.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaagcccctaagctcctgatctatgctgcatccagtttcgacgaagtcggggtcccagtcaaggttcagtggcagtgatcgtgggacagtatttcgactctcaccatcaaacagtctgactaaacccgtgaaagtattttagacctaaactttacctaacttgtactaaacgtagtacgtttactaccctaccccttacttcctacggtttacgggaccgggggtaccgaacggtggacgaagtacgaaacgacgtagtcggctgacc

SEQ ID NO: 347219 - DNA, 621 bp, Homo sapiens
  misc_feature: GZ8MTXP02FOMTX.3.38.D05.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttaatttaaattggtatcagacaagaaaccgaagggaaacncccctaaagcctcctagatctatgctgcacttccgtagtttacgacgtaaaacggtcggggtaccccaagttacggtaaacggtttcgaaggttgggactaggtggtactcgtggggaactagtactttcacttctacaacctatacaactagtctacgaccaaacctagtaaagtacttttagaccttaaacctttactaaccttagtactaaacgtagttacttacctacctaccccttctaccgtacggtttaccggggacgggggtaaccgtaacgggtagaacgtaactaacgaaaacggtaacgtacggtcggtacctacggaccacgttaac

SEQ ID NO: 347220 - DNA, 545 bp, Homo sapiens
  misc_feature: GZ8MTXP02IOP3O.3.38.D05.1.454.CMB.2.raw
  modified_base (286)..(286): a, c, t, g, unknown or other
  misc_feature (286)..(286): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagtcttaattaaattcggtatccgagacagaaaccgagggaaacncccctaagctacctagtactctatcgtctcgactactcctagtttcgacgaagtcgggtaccatcgaggtcagtggactgtgntcgnggacagtactttcactctacaccattacaactgtctgaacactagagttatacgacttaaacttctactagtacaacgtagttacttaccacttaccctgtacctacggttccgggggaccggggtaactaggtaccgaagaactaacgaaacggtactggacgtacacgac

SEQ ID NO: 347221 - DNA, 545 bp, Homo sapiens
  misc_feature: GZ8MTXP02H0LR5.3.38.D05.1.454.CMB.2.raw
  modified_base (271)..(271): a, c, t, g, unknown or other
  misc_feature (271)..(271): n is a, c, g, or t
  modified_base (537)..(537): a, c, t, g, unknown or other
  misc_feature (537)..(537): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgcggacagtcagagcatagcagctattaatgtatcagcaagaaacaggaaacncccctaagcctctagatctatactgcactccagtttgaccgtaaaggtcgggtaccctagtacgtaacggttcaggttcgggactaggttggaacttcggaggggtaactagtactttaccacttcctacaaccctatacaactagtctacgtacaaccgttagaagttattttcgactaaacttactactacgtacaactgtacttcacctaccctctaccgtacgttcggacggggactaggcgacgataacgaacgactgtancgtgacac

SEQ ID NO: 347222 - DNA, 601 bp, Homo sapiens
  misc_feature: GZ8MTXP02HGYJO.3.38.D05.1.454.CMB.2.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgggnaagtcagagcattagcagcttatttaaatggtatcagcaagaaaccgaaggaaacgcccctaaagctacctgatctatgctgctatcctagtttcgacaaaggtcgggtcccagtcaaggttcagtggacaggtgatcgtgggacagtattcactctacacatacaacagtctacgaccaaaccgttagaaacgttatttacgaccttaaacttaccttacttagtacctaaacgtgttaacgttttaccaacccctttaaccctcctttacctaacgggtttttaccgggggaacccgggggtaacctaaaacgggggttggaacggtaaacgttacccgaaaagtaaccgtaggtcgtacgttacggtaacccg

SEQ ID NO: 347223 - DNA, 611 bp, Homo sapiens
  misc_feature: GZ8MTXP02FLFEF.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagacaagaaaccaagggaaacgcccctaagctcctgatctatgctgcatcctagtttcgacgtaaaggtcggggtacccagtacgaaggttcagtggacagtgatcgtagggactagtatttcacttctacaccactacaaactagtactacgacctaaaccgtagtaaacgttattttacgaccttaaacttaccttaactacgtaacctaaacgtaggtacgttttaccaacccttaacccccttcgttaccgttaaccggtttcccgggggaacgggggtaacccgtaaagggggtcggtaaagtaacgttaaccgaaaacggtaactgggtacgcgtacgaacc

SEQ ID NO: 347224 - DNA, 699 bp, Homo sapiens
  misc_feature: GZ8MTXP02JAAMI.3.38.D05.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaaggtcagagcattagcagcttaatttaaatggatcagacagaacagggaacnccctaagctctgatctatgctgactatcctaggtttcgacgtaagggttccgggtacccagttaccgtaaaggttccaagggttcgggacaagggttcggaacttcgggtaggggaactaggttaactttcgaaaccttctactaaccctagtacctaaaccgtacggttaccttacggaacctaaacccgttaggtaaacgtttattttacggtaaccttaaaacgttttaccttaaaccggttacgtaaacctaaaccggtaaggttaaccgttttacctaacccgtttaccccctttacttaccggttacccggggttttaccgggggaacccggggggttaaactaaaccgggggtcggtaaacggtaacgttaaccggaaaacgtacggtacggtacggtcgtacgacctacgtttacg

SEQ ID NO: 347225 - DNA, 654 bp, Homo sapiens
  misc_feature: GZ8MTXP02IDFEE.3.38.D05.1.454.CMB.2.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggacaaggtcagagctatagcagcttaatttaaatggtatcagcaagaaaccaagggaaacncccctaaagcctcctagatctagtcgctgacactccgtagtttcggacgtaaagggtccggggtaccctagtacgtaaaggtttcaagggttcggctaggtcggattccgtaggggactagtactttacacttctacaccctataccaactgtctacgacctaacgttagaatttactttacgtaactaaactttactacttagtaactaaacgtacgttaaccgttttaccaacccctttacccctacgtttaccgttaccggggttttaccgggggaaccgggggtttaaacccggaaacgggggtaacggtaacggtaaactaaccggtaaaaacgttcgtaagggtcgtacgtacgaccgtaactacg

SEQ ID NO: 347226 - DNA, 556 bp, Homo sapiens
  misc_feature: GZ8MTXP02I2ME3.3.38.D05.1.454.CMB.2.raw
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
tcagagacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggcaagtcagagcattagcagctatttaaatggtatcagcagaaaccaggaacncccctaagctcctgatctatgctgcatcctagttgacaaggtcgggtacccatcaaggttcagtggcagtggatcgtgggaacagtatttcacttctacactatacaacacgtctacgactaacctagtaaagttattttacgactaaacctttactaaacctcgtactaaactagtaactttccaacctaccccttctaccttacggtttaccggggacgggggtaacctaaacggggtgaacggtactacgaaaacgtacgtagtcggactacgcctaactacg

SEQ ID NO: 347227 - DNA, 536 bp, Homo sapiens
  misc_feature: GZ8MTXP02G4WNJ.3.38.D05.1.454.CMB.2.raw
  modified_base (271)..(271): a, c, t, g, unknown or other
  misc_feature (271)..(271): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccggcaagtcagagcattagcagctattaaatggtatcagcagaaaccaggaaacncccctaaagctcctgatctatgctgcatcctagtttagacgtaaaacggtcggggtacccatcgtaaaggttcaagtggacagtggatcgtgggacagtattcactcncacatacaacngtctagacaactagaaagtatttacgactaacttactactgtacaactagtacttcactaccctctacgtaccgtttcgggacggggtactaacgggtgaacgtactaacgaaaacgtacgtacggtacgcgtacgacctactacg

SEQ ID NO: 347228 - DNA, 643 bp, Homo sapiens
  misc_feature: GZ8MTXP02HK3IO.3.38.D05.1.454.CMB.2.raw
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggttccagatgtgacatcctgatgacccagtctccatcctccctgtctgcatctgtaggagacagagtcaccatcacttgccgggnaagtcaggcatcagcagtctaatttaaacgttggttcagcaagacgatcgaagggaaacncccctaaagcctcctgaactacagtggtnacatacgtaacgtttaagaaaggttggtaccgtacccattacgtaaagggttttagnggctggtggatccgtaggggactaggtagtttccaaccttctacccacctaactccaacccgtagttcctacggacctaaaccgtagtaaacgtttatttacgaaccttaaaccttttactaactacggttaaccaaaccgtagttaacgttaacctaccgttacgttaccccgttccggttcctaaccggtttcggggaccggtccggggaaaccgtagggtcggacggtacgaggaaccgtacgttggtacgggccttacggacctaaccgtc

SEQ ID NO: 347229 - DNA, 696 bp, Homo sapiens
  misc_feature: GZ8MTXP02I69WG.3.38.D05.1.454.CMB.2.raw
  modified_base (202)..(202): a, c, t, g, unknown or other
  misc_feature (202)..(202): n is a, c, g, or t
tcagagacgcactccacgaccggtgctcgatttagtatctgataggttgggtttgggggagtcagtctcagtcaggacacagcatggacatgagggtccccgctcagctccgtggggctcctgctactctggctccgaggtgccagatgtgacatccagatcgacccagtcctccatccctcctgtctgcatcgtgtagganacagacgtccaaccatccacgttggccgggacaagtcagagcattagcagcttaatttaaatggtatcagacaagaaaccaggaaacgcccctaaagctctgatctatgctgctactccgtagtttcgactaaaacgggttcggggtaccccctaagttacgtaaaggtttccgaagggttcggggacctagggttagggtaacttccgggtaggggaacctaggtactttcacttctaccaactaactacaacgtaacttcgacgacctaacgtagtaaacgttactttttacgaaccttaaactttactaacgtttagaacctaaacgttacggtaactttcccaaacccgttaacccccttcgtaacccgttaccggttttacccgggggaaccgggggtaaaacccgtaagggggttaccggaaacggtaaccttaaacgaaaaccggtaacttcgggttacgggccttacgggaccgtaaccttaaccg

SEQ ID NO: 347230 - DNA, 554 bp, Homo sapiens
  misc_feature: GZ8MTXP02FOCER.3.38.D05.1.454.CMB.2.raw
  modified_base (276)..(276): a, c, t, g, unknown or other
  misc_feature (276)..(276): n is a, c, g, or t
  modified_base (399)..(399): a, c, t, g, unknown or other
  misc_feature (399)..(399): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaatggtatcagcaagaaaccaggaacncccctaagctcctgactctatgctgctatcctagtttgacgtaaacggtcggggtacccagtcgaaaggttcaaggtggctaggtggatcgtagggacagtatttcactcacactatacaacngtctagacactagaaacgtatttcgactaacttactactcgtactaactagtacttccaccttacccctctacgtacggtttcggggaccgggggtaacctaagggtcgaacgtactacgaaaacgtacgtacggtacgctacgtaccacttacg

SEQ ID NO: 347231 - DNA, 630 bp, Homo sapiens
  misc_feature: GZ8MTXP02IW2A6.3.38.D05.1.454.CMB.2.raw
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
tcagagacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagatcaccatcacttgccggnaagtcagagcattagcagtacttaatttaaattgatcagcaagaaaccaggaaacncccctaaagctcctagtactactatgtctgtactactacgtacgttacgacgtaacggtccggtacctacgtacgtacgtacgtacggtacggtcgtaggtagtacgtacggtacggtaacgtacgttacttactacctacctaccacctactaactaacgtacgtacgtacgtactaacgtacgtaacgtacgttacgtaaccttaaccttacttacgtacgtaactaacgtacgttacttacctacccttaccctaccgttaccgttaccgggttaccggggtaccggggtaccggtaacggtacggtaacgtaacgtaaccgtaaacgtacgtacggtacgtacgtacg

SEQ ID NO: 347232 - DNA, 611 bp, Homo sapiens
  misc_feature: GZ8MTXP02GOR06.3.38.D05.1.454.CMB.2.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacttgccggacaagtcagagcatagcagcttaatttaatggtatcagcaagaaaccaggaaacncccctaagctcctgatctatgctgctatcctagtttacgactaaacgggtcggggtacccaagttaccgtaaagggtttccaagggttcggggaccgtaaggggttcgggacttccgggttagggggaaactaggttactttcctaaacttcctaccaaacctatacaaactgtctacgaccaaactaggtaaatattttacgacttaaacttactactacgttacaactagttacttccaaccttaccctctaccgtacggtttaccggggaccgggggtaacagggtacgaacgtacgtaaacgaaacgtacgtaggtacggctacgcaacttac

SEQ ID NO: 347233 - DNA, 581 bp, Homo sapiens
  misc_feature: GZ8MTXP02HQ9GW.3.38.D05.1.454.CMB.2.raw
  modified_base (292)..(292): a, c, t, g, unknown or other
  misc_feature (292)..(292): n is a, c, g, or t
  modified_base (568)..(568): a, c, t, g, unknown or other
  misc_feature (568)..(568): n is a, c, g, or t
  modified_base (578)..(578): a, c, t, g, unknown or other
  misc_feature (578)..(578): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgaccccagtctccatcctccctgtctgcatctggtaggagacagatcaccatcacttggccgggcaaagtcagagcattagcagtcttaatttaaattggtatcagacaaagaaaaccgaagggaaacncccctaagcctactgactctatgctgctatccgtaagtttccgactaaacgggtgggtacccataccgtaaggttcaggtgctagtggatcggtgggactagtactttcacttcacacctagtacaaactgtactagacctaaacgttggtaaactttattttacgaaccttaactttaacacgttacgtaacaaacgttaggtactttacccaacctttaccccgtactacgtacggttcggggacggggacacgggtgagtaatacgaaacgtntggcgtctanacc

SEQ ID NO: 347234 - DNA, 573 bp, Homo sapiens
  misc_feature: GZ8MTXP02GU3YM.3.38.D05.1.454.CMB.2.raw
  modified_base (272)..(272): a, c, t, g, unknown or other
  misc_feature (272)..(272): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaacaggaaancccctaagctcctgatctatgctgcatccagtttgcaaacgtggggtcccatcgaagttcagtggcaggtggatcgtggggacagtatttcactctctaccatacaactagtctagcaaactagaatatttgactaactttactacttactactaaacagtaacgtttactaccctaccccttccttaccgttaccggttttccggggaccggggggtaaacccgtaaacggggtacggggtaacgtaacgttaccgaaaaacggtaccgtaggttacggggacttcggacctaacgtacg

SEQ ID NO: 347235 - DNA, 578 bp, Homo sapiens
  misc_feature: GZ8MTXP02HT0HI.3.38.D05.1.454.CMB.2.raw
  modified_base (224)..(224): a, c, t, g, unknown or other
  misc_feature (224)..(224): n is a, c, g, or t
  modified_base (578)..(578): a, c, t, g, unknown or other
  misc_feature (578)..(578): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatccctcctgtctgcatctggtaggagacagagtcaccatcacttggccgggnaagtcagagctatagcagctaatttaaatgatcagcaagaaacgaaggaacacccctaagcctcctagatctaatcgctcgactactaccgttagttacgaacgtaaccgggtccgggtaccagtacgtaaaggttcgaaggttggacgtaggtgtacgtacgtagggactagttactttacaccttctaccacactacaactacgtcgtacactaacgagtaagttatttacgaacttaactttactattacgaaccaagtacgttacttacctaccctacctacttccgtacggttcgggggacggtacgtaggacgacgaatacgaaacgtagtcgacgctacgactactn

SEQ ID NO: 347236 - DNA, 559 bp, Homo sapiens
  misc_feature: GZ8MTXP02IL16K.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagatcaccatcacttgccgggcaagtcagagcattagcagctattaaattggtatcagcagaaaccaggaaagcccctaagctcctgatctatgctgcatccagtttgactaaacggtggggtcccagtcaaggtttcagtggcaggtggatcgtgggactagtatttcactctcactatacaacagtctagacaactagaagtatttcgactaactttactactacgtacaactagtacgtttcctaacctaccctactactaccggtttaccggggacgggggtaaccaaagggtcggaaacgtacttaaccgaaaacgtaaccgttagtacgggtactacggtaccaccgttaacg

SEQ ID NO: 347237 - DNA, 525 bp, Homo sapiens
  misc_feature: GZ8MTXP02GMLQT.3.38.D05.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
  modified_base (393)..(393): a, c, t, g, unknown or other
  misc_feature (393)..(393): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtcacatcacttgccgggnaagtcagagcattagcagctatttaaattggtatcagcagaaaccaggaaancccctaagcctcctgatctatgctgcatcctagtttgacaaacggttcggggtacccagtcgaaaggtttcaggtggcaggtggatcgtagggacagtattcactctacaccatcaacngtctgacaacctgtaaagtattttcgactaactttactactacgtacaactagtactttccacctaccctctctacggttcgggacggggtacaggtcgacactacgaaacgtacgtgtcggctcgcactag

SEQ ID NO: 347238 - DNA, 553 bp, Homo sapiens
  misc_feature: GZ8MTXP02GN66G.3.38.D05.1.454.CMB.2.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatcactgccggnaagtcagagcattagcagctattaaattgtatcagacaagaaaccgaggaaacgcccctaaagcctcctgatctatgctgctatcctagtttcgacgtaaaggtcggggtaccctagtacgttaagggttcaacggtggcgtagtggatcgtagggactagtatttcactctcacactacaaacgtatactagacctaactagtaacgttatttagacctaacttactacgtatacaactagtacttaccaccttaccctctacgtacggttccgggacggggtaccaagggtgaagaacgtacgaaaacgtacgtagtcggactacgacc

SEQ ID NO: 347239 - DNA, 551 bp, Homo sapiens
  misc_feature: GZ8MTXP02H9STB.3.38.D05.1.454.CMB.2.raw
  modified_base (223)..(223): a, c, t, g, unknown or other
  misc_feature (223)..(223): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttgccgggnaagtcagagcattagcagctatttaaattggtatcagacaagaaaccgaagggaaacgccccctaagccttcctgatctatgctgcactcctagtttgacaaaggtcggggtcccagtcaaggttcagtggcagtggatcgtaggggacagtattcactctcacatacaacagtctcgtacactagaacgttatttacgactaacttactactacgtactaactagtacttaccaccttaccctctacgtacggttcggggacgggggtaaccgaagggtgaacgacgtaacgaaacgaacgttacggtacggctcggaccacttacg

SEQ ID NO: 347240 - DNA, 582 bp, Homo sapiens
  misc_feature: GZ8MTXP02H9Y33.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtcacatccagatgacccagtctccatcctccctgtctgcatctgtaggagacagagtcaccatcacttgccgggcaagtcagagcattagcagacttaatttaaatggtatcagcaagaaaccgaggaaacgcccctaagcctcctgatctatgctgcatcctagtttcgacgtaaggtcgggtacccagtcgaaggttcgagtcggacagtggatcgagggactagtacttcactctacacatacaatagtctgactaacctagaattatttacgactaacttactactacgtacaaacgtattaacgtttccacccttaccccttccgttaccgtaccggggtttacgggggaccgggggtaaccgtaaaggggttcggtaacgaacgttaaacgaaaacggtaaccgtggtacggcgtacgtaacccg

SEQ ID NO: 347241 - DNA, 566 bp, Homo sapiens
  misc_feature: GZ8MTXP02JVCPL.3.38.D05.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (403)..(403): a, c, t, g, unknown or other
  misc_feature (403)..(403): n is a, c, g, or t
  modified_base (556)..(556): a, c, t, g, unknown or other
  misc_feature (556)..(556): n is a, c, g, or t
tcagagacgcactccacgaccggtgctcgatttagtatctgatagttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtcaccatcacttgccggnaagtcagagcatagcagtacttaattaaatgtatcagacaagaaaccgagggaaacncccctaaagcctctgtatctatgctgcatcctagttcgacgtaaacggtcgggtaccatacgtaaggttcaggtgggactaggtggtatcgtagggactagtacttcactctacacatacaacngtctacgactaaactagtaagttatttacgaaccttaacttactactatacgaaactagttacttacctacctacccctcttaccgtacggttccggggaccggggtaaacaggggtacgaacgtaacgtaacgaaaacgtctacggcgtacncgacaactcg

SEQ ID NO: 347242 - DNA, 575 bp, Homo sapiens
  misc_feature: GZ8MTXP02HMLPJ.3.38.D05.1.454.CMB.2.raw
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatnagcaagaaaccagggaaacncccctaaagcctcctgatctatgctgcatcctagtttgacaaaggtcggggtacccagtcgtaaggttcagtggctaggtggatcgtgggatagtatttcactctacacctatacaactagtctgaccaactagaaacgttattttacgacttaaacttactacttacgtacaacgtagttactttccaaccctttaaccccttccttaccgtaccggtttacgggggaccgggggtaaaccgtaagggtacggaagtaacgtacgaaaacgtacgtggtacggctacgacctacgtac

SEQ ID NO: 347243 - DNA, 509 bp, Homo sapiens
  misc_feature: GZ8MTXP02FFMW2.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaagcccctaagctcctgatctatgctgcatccagtttgacaaagtggggtcccatcaaggttcagtggcagtggatctgggacagtattcactctcaccatcaacagtctgacaacctgaagattttgactaactttactactgtacaacagtacgtttacaccttacccctctcctacgtttcgggaccgggggaccaagggtgacgatacgaaacgacgtgtcggctcgacactac

SEQ ID NO: 347244 - DNA, 615 bp, Homo sapiens
  misc_feature: GZ8MTXP02GDT9E.3.38.D05.1.454.CMB.2.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacgttcgccggacaagtcagagcagttagcagtacttaatttaaagtggtatcgagacaaagaaaccgagggaaaccncccctaagcctccgtagacttctatcgctgctatccgtagtttgacgtaacggtccgggtaccagtacgtaaggtcgaggtcggctaggtgagtcgtagggactagtactttcacttctacactactacaactgtcacgactacgtagtaacgttactttacgacttaacttacgtactacgtaacctaacgtagttaccttacctaacccgtttaccccttcgtaccgttaccgggttaccgggggaccgggggtaaacctaaggggtacgaacgtaaccgtaacgaaaaccggtagttacggtacgaccgtcgaaccactttacg

SEQ ID NO: 347245 - DNA, 663 bp, Homo sapiens
  misc_feature: GZ8MTXP02GPXNI.3.38.D05.1.454.CMB.2.raw
  modified_base (205)..(205): a, c, t, g, unknown or other
  misc_feature (205)..(205): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatcgacccagtcctccatccctccctgtctgcatctggtagganacagatcacatcacttgccggcaagtcagagcattagcagtacttaatttaaagttggtatacagacaaagaaaccgaagggaaacgtaccccctaaaggcctaccgtagtacttactatgcctgactactccgtagttcgacgtaaggtcggggtaccagtacgtaaggttcaggtgacgtaggtgatcgtagggactagtacttcactacctacaacctactacctaaactacggtacttacgaacctaaaccgttagaacgtttacttttacgaacctttaaccttaacttacgttacggtaaccaaacgttacgtaacgtttaccctaacccttacccctcgttacccgttaaccggttttaccgggggaccgggggtaaaccgtaaggggtacgggaaacgtaacgtaaacgtaaaaccggtacgttcgggtaacgtccgtttacggaacccg

SEQ ID NO: 347246 - DNA, 530 bp, Homo sapiens
  misc_feature: GZ8MTXP02FK34V.3.38.D05.1.454.CMB.2.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaatggtatcagcaagaaaccagggaaacgcccctaagctcctagatctatgctgcatcctagtttcgacgtaaaggtcggggtcccatacgaaggttcaggtggcagtgatcgtgggacagtatttcactctcaccatacaacngtacngacaactagaagttatttgactaattactactacgtacaacagtacgtttcacctacccctctcctaccggtttcgggacgggggtaccgtaagggtgaagaagtacgaaacggtactcggacggtctgacc

SEQ ID NO: 347247 - DNA, 582 bp, Homo sapiens
  misc_feature: GZ8MTXP02FXE70.3.38.D05.1.454.CMB.2.raw
  modified_base (278)..(278): a, c, t, g, unknown or other
  misc_feature (278)..(278): n is a, c, g, or t
  modified_base (497)..(497): a, c, t, g, unknown or other
  misc_feature (497)..(497): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttattaaattggtatcagcaagaaaccaagggaaacnccccaaagcctcctgatctatgctgctactccgtagtttcggacgtaaaacggtcggggtaccccaagtacgtaaacgggtttccaagggttcgggacgtagggttagggaacttccgttagggggaacctaggtaacttttcaacctctaccacctactacaactagtactagacctaacctagaaagtatttgactaactttactactacgtacaanagtacttacacctaccctctctacgttcggacggggtacagggtacgagtacacgaaacgtacgtagtcggactcgacctactac

SEQ ID NO: 347248 - DNA, 589 bp, Homo sapiens
  misc_feature: GZ8MTXP02GK34X.3.38.D05.1.454.CMB.2.raw
  modified_base (281)..(281): a, c, t, g, unknown or other
  misc_feature (281)..(281): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggcaagtcagagcattagcagctatttaaattggtatcagacaagaaaccgaagggaaacncccctaaagcctcctgatctatgctgctatcctagtttcgacgtaaaaggtcggggtaccctatacgtaaggttcaggtgggcaggtggatcgtagggacagtactttcactctacaccatacaactgtctacgactaactagaaagttattttcgacttaaactttactacttacgtacaactagttacgtttaccaccttacccctcttactacggtttccggggaccgggggtaaaccaagggttcggaacgtaacgtaaccgtaaaacgtaacgttcggtacggtactacggacctaccttacg

SEQ ID NO: 347249 - DNA, 652 bp, Homo sapiens
  misc_feature: GZ8MTXP02GUQYI.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctaattaaattggtatcagcagaaaccaggaaancccctaagctcctgatctatgctgcatcctagtttgactaaagtcggggtacccatacgaaaggtttccaaggtcgggacaggtaggtatcggtaggggaaccgtagttaactttcaaccttctaccaacctaattaccaaactaacggtctacggacctaaaccgtagtaaagttacttttacgaaccttaaactttaaccttaacgtacgttaccaaaacgtacgttaactttacctaacccttaacccccttccgttacccgttaaaccgggttttcccgggggaaccggggggtaaaccctaaaggggttacggaaacgtacgtaaacgtaaaacggtaacgtacggtacggccttacggacccactttaaccg

SEQ ID NO: 347250 - DNA, 576 bp, Homo sapiens
  misc_feature: GZ8MTXP02GOK88.3.38.D05.1.454.CMB.2.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctatttaaagtggtatcagacagaaaccaggaacnccctaagctctagatctatgctgctatacctagtttacgactaaacgggtcggggtacccagttaccgtaaacggttcgaggtcgggctaggtggtatcgtaggggaactaggttactttacaacttctaccacctaatacaaactacgtctagacctaacgtagtaaagttactttcgtactaactttactatacgtacaactaggtacttaccacccttacccgtactccgtaccggttcggggaccggggtaccaaggtcgaacgacgtaacaaagtactggacggctacgccaactcg

SEQ ID NO: 347251 - DNA, 563 bp, Homo sapiens
  misc_feature: GZ8MTXP02IM5TT.3.38.D05.1.454.CMB.2.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggcaagtcagagcattagcagctatttaaatgtatcagcaagaaaccaggaaacncccctaaagctcctgatctatgctgcatccagtttgacgtaaacggtcggggtacccagtacgtaaggttcagtcggacagtggactcgtgggactagtactttcactctacaactatacaaactgtctacgactaactagtaaagttatttacacttaaacttactacgtatacaaactaggtactttaccaaccttaccctcttacgtacggtttcggggaccggggtaacgtaacgggtagtacgactaacgaaaacgtacgtggtacggacttacgactactac

SEQ ID NO: 347252 - DNA, 576 bp, Homo sapiens
  misc_feature: GZ8MTXP02IEYEY.3.38.D05.1.454.CMB.2.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (426)..(426): a, c, t, g, unknown or other
  misc_feature (426)..(426): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccggaggtgccagatgtgacatccagatgacccagtcctccatccctccctgtctgcatctgtagganacagagtcaccatcacttgccgggnaagtcagancattagcagnttaatttaaatggtatcagcaagaaaccaggaacncccctaaagctaccngatctatgctgcatccgtagtttgacgtaaaggtcggggtacccctagtaccgtaaggtttcaggttggggactaggtcggattcggtagggactagtaactttcacttctacaacctatacaactagtctnaccaacgtagtaaacgttattttcgactaaactttactacctagtacctaactacgtactttaccacttaacccctcttaccgtacggtttcggggacggggtaacaaggtcgactaatacgaaaacgtcgtaggtcgactcgacactcg

SEQ ID NO: 347253 - DNA, 677 bp, Homo sapiens
  misc_feature: GZ8MTXP02FWK63.3.38.D05.1.454.CMB.2.raw
  modified_base (224)..(224): a, c, t, g, unknown or other
  misc_feature (224)..(224): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcattgccggnaagtcagagcattagcagcttaatttaaatggtatacagacaagaaaccaaggggaaacacccctaaagcctacctgtatctatgcttgcatcctagtttcgacgtaaaggtcggggtacccagttacgaagggtttcaagggtcgggacaaggtgggtaattaccgtggggaactaacggttacttttacaaccttccctactaacccattaccgaacgtcgaacgcccgttaaaggaccgttccgttaaggtaagttagtttttacggacctttaaggttttactttaacccgttgttaccgacgtacgtaacggtaccggttaaagacccgtaaacgttcgggtaacccctttcgttacccgtacccggtttccggggaaccggggtaacggggtaacccgaaaagggggtaccgaaagggtaacttaaccggaaaacggttaaaccggg

SEQ ID NO: 347254 - DNA, 556 bp, Homo sapiens
  misc_feature: GZ8MTXP02JDV5C.3.38.D05.1.454.CMB.2.raw
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagcttaattaattggtatcagcaagaaaccgagggaaacncccctaagctcctgatctatgctgcatcctagtttcgacgaaaggtcggggtacccagtacgaaggttcagtggcagtggatcgagggactagtacttcactctacacatacaactgtctgaccaacctagaacgttatttacgacttaacttactactgtacaactagtacttaccaccttaccccgtacttccgtaccggtttcggggaccgggggtacgaaacgggtgaacgtaacgtaacgaaaacggtacgtggtacggtctacggaccc

SEQ ID NO: 347255 - DNA, 686 bp, Homo sapiens
  misc_feature: GZ8MTXP02G1RTA.3.38.D05.1.454.CMB.2.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatcgacccagtcctcactccctccctgtctgcatctgtagganacagatccaccatcacgttcggccggganaagtcaggagctaattagctaagtcttaaatttaaagttgggtaatcaagacaaacggaaaaccgaaacggggaaacctacccctaaagtcctaccgtagtactctaatcgtctcgactacgtcgtagttgaacgtaaacggtcgggtaccagtacgtaacggtctaggtgggactaggtcgagttacggaggtactaagttactttcgacccttacaccaacctacttaaccgaaactcgtacgtacgaccttaacgtaaggtaatttacgtttaccgaactttaaaccgtttactaccgtaagtaaccctaagttaacggttacttaccctaaaccccttcccgttccgtaccggttacccggttaccgggggaccggggttaaactacgggggtacgaaacgtacgttaaacccgaaaagtcgtacggtacggtacctccgaaccttcgttacg

SEQ ID NO: 347256 - DNA, 580 bp, Homo sapiens
  misc_feature: GZ8MTXP02FXBN0.3.38.D05.1.454.CMB.2.raw
  modified_base (389)..(389): a, c, t, g, unknown or other
  misc_feature (389)..(389): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcaagaaaccagggaaacgcccctaagctcctagactctatgctgcctatcctagtttcgacctaaaggtcggggtacccagtaccgaaagggttcagtggacaggtgatcgtgggacagtactttanactctcaaccataccaagtacgtactgaaccaactagtaagttatttcaactaaacttaactacgtactaacaaactagtacgtttaccaaccttaacccctcgttacctacggtttacggggaccgggggtaaaccaagggttggaaacgtaacgtaacgaaaaccggtacgtaggtcggacctacgacc

SEQ ID NO: 347257 - DNA, 714 bp, Homo sapiens
  misc_feature: GZ8MTXP02FOXOQ.3.38.D05.1.454.CMB.2.raw
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccatccacttggccgggcaagtcagagcattagcagcttattaaattggatcagtcaagaaaccagggaaacncccctaaagcctacngtactctatcggctgctactccgtagtttcgaacgaaacgggtcggggtaccctagttaccgaaaggggtttccaagggttggggacctagggttagggaacttcgttagggggaactacgttaactttcaaccttctacaacctattaccgaaactacgttacgacgtaaccaaaccgttaaggtaaacttaagttttaccgactttaaaaccctttactaaccttacgtaacctaaacgtacgtttaacgtttacctaaccccgttacccccttcgttaccggttacccggtttttaccggggggaacccggggggtttaaacccaaaacgggggtggtaaaacggtaacgttaaaccggaaaaccggtaaacgtccgggttaaacgggccgttaaacccgtaccgtaaccgttacg

SEQ ID NO: 347258 - DNA, 611 bp, Homo sapiens
  misc_feature: GZ8MTXP02F5CTF.3.38.D05.1.454.CMB.2.raw
  modified_base (197)..(197): a, c, t, g, unknown or other
  misc_feature (197)..(197): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttaatttaaatggtatcagacaagaaaccgaaggaaacgacccctaaagcctcctagtactctatgactgactatacctagtttacgaacgtaaacgggtcgggtacccagtaccgtaaggttccgagtgggactaggtaggtatcgtagggactagtacttacactctacacctataccaacacgtactagacctaacgttaagtaacttatttacactaaactttactatacgtaacaactagttactttacacccttacccgttactaccgttaccgggtttacggggaccgggggtaaacctaaaggggtacgaacgtaacgtaaacgaaaacgttaacgtggttacggctacaccctaacttacg

SEQ ID NO: 347259 - DNA, 632 bp, Homo sapiens
  misc_feature: GZ8MTXP02G6ZXO.3.38.D05.1.454.CMB.2.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggnacagatcaccatcacttgccggnaagtcagancatagcagctaattaaatggtatcagacaagaaaccgagggaaaccncccctaagcctcctagattctatgactcgctactccgtagtttcgactaaacggtcgggaccctagtaccgtaaggttcgagtcggacaggttggacttcgtaggggtactagttactttacaccttactaccaaaccattaaccaacgtacgtactacaccgtaaccgttagtaaacgttactttttacggaacctttaacctttaacgtaacgttacgaactaaacagttaacctttccaccctttaacccgtccttacgtaccggtttaccgggggaccgggggtaacctaaagggtacgaaacgtacgtaaccgtaaaacgtcgttaaggccggttacacgtaccaccttacg

SEQ ID NO: 347260 - DNA, 622 bp, Homo sapiens
  misc_feature: GZ8MTXP02GKH1V.3.38.D05.1.454.CMB.2.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (418)..(418): a, c, t, g, unknown or other
  misc_feature (418)..(418): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatcgacccagtcctccatccctccctgtctgcatctgtagganacagagtcaccatctacttggccggganaagtcagagctattagcagtacttaatttaaagtgtatcagacaagaaaccgaggaacctccctaagcctcgagtactctatgctgactactccgtagttacgacgtaaacgggtccggtacctagtacgtagttcgaggtcggacaggtgatcggtaggatgtacttcacctctacacactacaacgtntccgagacctaacgttagtaaacgttcttttacgaaacttaacctttaactacgttaaccgtaactaaacgtacgttaccttaccctaacccgttccccttacgttaccggttacggggtttaccgggggaaccggggtaaacctaaggggacgtaacgtaacgtaaccgaaaacgttcgtaggtccgagtaccactaacgtcg

SEQ ID NO: 347261 - DNA, 656 bp, Homo sapiens
  misc_feature: GZ8MTXP02FG4NH.3.38.D05.1.454.CMB.2.raw
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttggccggganaagtcagagcattagcagcttaattaaatggtatcagcaagaaaccaagggaaacgcccctaagcctccngatctatgctgcatcctagtttcgacgtaaaggtcggggtaccctagtaccgtaaagggtttcgaaggttcggacgtaggtcggtaatccggtaggggtaaactaggttaacttttaccaacttcctaacccaacccaattaccaaaacgtggttaccaacggaaccctaaaccgtaggtaaagtttacttttacggaaccttaaactttacctactacgtaaccaacgtagtaacttttccaaacccttccccttctaccgttaaccggtttaccgggggaccgggggtaaccgtaagggggtcgaaaacggtaacgttaaaccgaaaacggtaacttgggtacgccgtacggaaccc

SEQ ID NO: 347262 - DNA, 697 bp, Homo sapiens
  misc_feature: GZ8MTXP02JRH5L.3.38.D05.1.454.CMB.2.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatcgacccagtcctccatcctccctgtcctgcatctgtagganacagagtcaccatcgacttggccgggcaagtcagagctattagcagtcttaatttaaagttgactcaggacagaaaccgagggtaaacccnccctagtcctcatatctagtcnctcgactacttcgtagttcgaacgtaaccgggtccgtacctagtacgtaggtcgagtcgggacgtaggtaggtacgtacgtacggtacgtacgttacttactacctacctacctaacctaacctaactaaccgtacgtacgtaccgtaccgtaaccgttaacgttaacgtttaacgtttacgttaaccttaaccgtttaaccttaaccgttacgtaaccgtaaacgttaacgttaaccgttaacccttaaccccttaaccccttacccgttaccgttacccgggttaccgggggtaccggggtaaccgggtaaacgggtaacggtaacgtaacgtaaaccgtaaaccgtaacgtacggtacggtacgtacgtaccgtacgtacg

SEQ ID NO: 347263 - DNA, 692 bp, Homo sapiens
  misc_feature: GZ8MTXP02FY70P.3.38.D05.1.454.CMB.2.raw
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggcaagtcagagcattagcagtacttaatttaaattggtaatcaagacaaagaaaaccgaagggaaaccgcccctaaagcctaccgtgtaacttctagtcgctgactactccgtagtttacgacgtaacggtcggggtaccctagtacgtaacgggttcgaggtcggtacgtagtagggtacgttcgggtaggggtaaccttagtactttacctaaccttccttaacccaaccctaacttaacctaaaacgtacggttaccacgtaaaccgtaaaccgttaggttaaacggtttattttaccggtaaccttaaaacctttaaccgttacttacgtaacctaaacgtacgttacctttaccctaacccttaccccttcgttaccgtaccggtttccgggggaaccgggggtacctaaggggtcggaagtaacgtaaccgaaaacggtacgtggtacggtactcggtaacc

SEQ ID NO: 347264 - DNA, 601 bp, Homo sapiens
  misc_feature: GZ8MTXP02I6KGF.3.38.D05.1.454.CMB.2.raw
  modified_base (315)..(315): a, c, t, g, unknown or other
  misc_feature (315)..(315): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (487)..(487): a, c, t, g, unknown or other
  misc_feature (487)..(487): n is a, c, g, or t
  modified_base (516)..(516): a, c, t, g, unknown or other
  misc_feature (516)..(516): n is a, c, g, or t
tcagagacgcactccacgaccggtgctcgatttagtatctgatagttgggtttgggggagtcagtctcagtcaggacacagcatggacatgagggtccccgctcagctccgtggggctcctgctactctggctccgaggtgccagatgtgacatccagatcgacccagtcctccacttccctccctgtctgctatctggtaggagacagacgtccaacctatcctacgttcggaccgggacaagtcaggacgctaagttacgctagtacttaatttaaagtggatcgaagacaaacggaaaccgaagggaaaccnccccgtaagcctacgtagtacttactagtcgacgtgactacttaccgtagttacggacgtaacgggtccgtaccagtacgtagtcagngatggtagatggagatactcttcncctactacaactnacacgntcgacgaacctagtagtaacttnttaacacttaactacgtnactacaattacgtctacccaccgttaccngttacgtccggggttaccggggacggtaaactagggtcaaacgttaacgacgtaaacgtcgtagttcgacgtacgaccttaatcg

SEQ ID NO: 347265 - DNA, 642 bp, Homo sapiens
  misc_feature: GZ8MTXP02G0ZO5.3.38.D05.1.454.CMB.2.raw
  modified_base (285)..(285): a, c, t, g, unknown or other
  misc_feature (285)..(285): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttcggccgggacaagtcagagctattagcagtcttaatttaaatggtatcagacaagaaaccgaagggaaacncccctaagctcctagatctatcgctgactacgttacctagtttacggacgtaaacgggttccggggtaccctaagttacggtaaacgggtttcaagggtcgggtacgtaggttagggaacttccggtaaggggaactaacggtttacttttaccaaaccgttctaaccaactaacttaccaacgtacggtactagacctaaacgtagtaaacgttatttacgacttaaacgttactactcgtaacaacgtacgtactttaccaccttaccctacgttaccgtacgggtttaccggggacggggtaacaaagggtccgaagtactaacgaaaccgtgtacgtcgtctacgccacttac

SEQ ID NO: 347266 - DNA, 740 bp, Homo sapiens
  misc_feature: GZ8MTXP02G8DHL.3.38.D05.1.454.CMB.2.raw
  modified_base (484)..(484): a, c, t, g, unknown or other
  misc_feature (484)..(484): n is a, c, g, or t
tcagagacgcactccacgaccggtgctcgatttagtatctgatagttgggtttgggggcaggagtcagtctcagtcaggacacagcatggacatggagggtccccgctcagctcctggggctcctgctactctggctccgaggtgccagatgtgacatccagatcgacccagtcctccactccctccctgtcctgctatcgtggtaaggagaacagagtccaaccatctacgttcggccggacaagtcgagacgactaagttacgactaagttaactttaaagtttaaagtggtactacgaagaaccgaaaacggaaaccgggaaacgggaaacccgtacccctaaggtcctacgtagtactcgttacgtcgtctacgacctacgtacgttaggtaccggaacgtaacgggtccggtacctagtacggttaacgtcgtagtggacgtaggtgtacggtcggtacgtacgttattaccgttaccncctaacctaccgaaacctacgaaaaccgttcgtaacggtttcccaacggaaacccgttaggtaaagtttaactttcgtaacccttaacggttaaccttactacgtactaactaaggttaccctttactccccgaccctttaacgtccggtaagggttacccgggggtaacgggggaccgggtaaaagtcgggtaacgaaactaaaccggtaacgtaaaacgggttcccggtagtaccgggtaaacctctaacccgg

SEQ ID NO: 347267 - DNA, 586 bp, Homo sapiens
  misc_feature: GZ8MTXP02JECKC.3.38.D05.1.454.CMB.2.raw
  modified_base (280)..(280): a, c, t, g, unknown or other
  misc_feature (280)..(280): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggcaagtcagagcattagcagtctatttaaattggtatcagcaagaaaccgagggaaacncccctaaagcctcctagtactctaatcgactgaccattcctaagtttcgaccgtaaaagggttcggggtacccctaagttaccgtaaaggttccgagggttcggcgtaagggtggacttcggtaggggaactagtaactttcaccttctacaccatacaacagtactgacaacctagaattactttacgacttaacttacgtactacgtacaacgtagtacttacctacctaccctctacgtaccgttcggggaccggggtacaacgggtcgacgactaacgaacgactacgcgactcgacactac

SEQ ID NO: 347268 - DNA, 559 bp, Homo sapiens
  misc_feature: GZ8MTXP02IFHAS.3.38.D05.1.454.CMB.2.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagagacgcactccacgaccggtgctcgatttagtatctgatagttgggtttgggggagtcagtctcagtcaggacacagcatggacatggacgggtccccgctcagctccgtggggctcctgctactctggctccgaggtgccagatgtgacatccagatcgacccagtcctccatccctccctgtctgctatctggtagganacagatcaccntcacttcggccgganagtnagagcattagcagtcttaatttaaatgancagacaagaaaccaggaaccnccctaagctcganactctatgcngacacttaccgtagttcacgtaaagggtccggtaccctagtcgaagtttcgagtgggcaaggtcgagtcgaggactaagtactttcacttacgtccaacacgtacaactgtcngacactntaaacgtntttacgactaaccttntaactcaacaatacgttacttacaacccttcctcgtacgtacggttccgggggaacggtacaaggggtcagttacaacgaacgacgtacgtagcgtactacaactcg

SEQ ID NO: 347269 - DNA, 582 bp, Homo sapiens
  misc_feature: GZ8MTXP02FMNUP.3.38.D05.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagcttaattaaattggtatcagacaagaaaccaagggaacacccctaagctactgatctangctgactatccagtttgacgtaaacgtcggggtacccagtccgtaaaggttcaaggttggacgtaggtaggtactcggtagggactagtactttcaacctctacactatacaacctgtcctgaccaactagaatactttagaactaaccttactatacgacaactgtaacttacaacccgtaccccttcttaccgttaccggttacgggggacgggggaaacctaaggggtcgaaacgattaaccgaaaacgtaacttcggtcggtatacgaccactttaacg

SEQ ID NO: 347270 - DNA, 549 bp, Homo sapiens
  misc_feature: GZ8MTXP02H21LZ.3.38.D05.1.454.CMB.2.raw
  modified_base (289)..(289): a, c, t, g, unknown or other
  misc_feature (289)..(289): n is a, c, g, or t
  modified_base (299)..(300): a, c, t, g, unknown or other
  misc_feature (299)..(300): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgccactctggctccggaggtgccagatgtgacatccagatgacccagtctccatcctccctgtctgcatctgtaggagacagagtcaccatcacttgcggcaagtcagagcattagcagtctaattaaatggtatcagacaagaaacaggaaacgccctaagccnctgatctatnntgcatcagttcgacaaaaggtcgggtaccatacgtaaggttcgaaggtggctaggtagaatcgtcggggaacaggtaatttcaactcctanaccatacaacacgtcngacaactagaacgtattagactaaaccttatacgtatacaacatacgttactaaccttacccctcttacgtacggtttccggggacgggggtaccgaaggttacggacgaacgtacgaaaacgacgtaggtacgctacgacc

SEQ ID NO: 347271 - DNA, 552 bp, Homo sapiens
  misc_feature: GZ8MTXP02JOOIR.3.38.D05.1.454.CMB.2.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcacatcacttgccggnaagtcagancattagcagctaatttaaatgtatcagcaagaacaggaancccctaagctcngatctatgctgacatcctagtttgactaaacggtcgggtccatactaaggttcagtgcgtagacggtatcgtagggactgtaacttcactctacacnctaacacagtctacgactaaccgtgtaaacttntttaacgactaaacgttttactaagtttctaacccgaaaagtcggtacttagaacctcgtacctcccgtcttacgtacgttcgggacggtaacggaccgaaggggagtaagacgttaacgaaaacgactggtacgcgtaacg

SEQ ID NO: 347272 - DNA, 773 bp, Homo sapiens
  misc_feature: GZ8MTXP02IN4J0.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatcgacccagtcctccatccctccctgtctgcatctggtaggagacagagtccaccatctacgttggcgggacaagtcaagacgctaattacgctagtactttaaattttaaagttggtaactacaagacgaaacggaaaacccgaaaggggaaaacccgtccccctaaagcccttacccgtagtacttaccttaagtcggactacgaccttacgttccgttaggtttacggaaccgtaaaaccggggttccggggtacctacgtacgtaagggttccgtaagggtcgggacgtagggtacggtagtcgggtagggaaactagttactttccacttcctaccaacctataccaagtcgtcgtacgacctaaacgtaggtaacttttagttaccgtaacttaaactttcgaacgttacgtaaacctaaacggtagtttaaccgtttcccccaaaccctttacccccgttacgttaccggttaaccccggggttttccgggggggaaacccgggtaaaccgttaaacggggtcgggtaaaaccttaaacggtaaaccgtaaaaaaccggttggtcccggttacggggacccttacggaacccctttacgtttaacccg

SEQ ID NO: 347273 - DNA, 704 bp, Homo sapiens
  misc_feature: GZ8MTXP02FMSNS.3.38.D05.1.454.CMB.2.raw
tcagagacgcactccacgaccggtgctcgatttagtatctgatagttgggtttgggggagtcagtctcagtcaggacacagcatggacatggacgggtcccccgctcagctccgtggggctcctgctactctggctccgaggtgccagatgtgacatccagatcgacccagtcctccactccctccctgtctagctatcgtagtaggagacagacgtcacctatcacgttcgaccggaacagtcagtacgactaattaggctagtactttaaatttaaagttgtactacgacgtacgaaacgaaaccgagggaaaccctacccctaagccctacgtagattctagcgtctgactaccgtcgtagttacgaacggtaaccggttccggtacccagttacgtaaggttaccgagggttcgacgtaggttggtagtaccggtaaggacctagttaccttacaaccttcaaccaccgtactaacgaaacgtcttaccgtacgaaccgtacgttaaagtaactttacgttttacgaaaccctttaaccgttactacgtaccgtaaacacggttacgtttaacctccctaaaccccgttccgtacgttacccggttacgggggttaccgggggaaccggtaaagtaccggggtagaaacctaacgttaaacccggaaacgttggtaccggacgttcaccgacttacttag

SEQ ID NO: 347274 - DNA, 715 bp, Homo sapiens
  misc_feature: GZ8MTXP02JYWZ2.3.38.D05.1.454.CMB.2.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtagganacagatcaccatcacttgccggganaagtcagagctattagcagtacttaatttaaagttggtactcgagacgaaacggaaaaccgaaggggaaaccgtacccccgtaaagtcctacccgtagacttactagtcgtctagctacttccgtaagtttcggacgtaaacgggtccggggtaccctagtacgtaaggttcgaggtcggacgtaggtggagttcgtaggggactagtactttccaccttctaccacctactaccaacgtacgttctacgacctaaaccgttaggtaaacgtttacgtttacgaaccttaaacctttaccgttaacttacgtaaccgtaaacgtacggttaaccgtttacctaaccccttacccccgttaccgttacccggttaccgggtttacccgggggacccgggggtaaaccgtacggggttaacggaaacgtaacgtaaacccgtaaaacggtacggttacggtaccggtaccgttaccgaacccgtaaccttaccg

SEQ ID NO: 347275 - DNA, 869 bp, Homo sapiens
  misc_feature: GZ8MTXP02JBML6.3.38.D05.1.454.CMB.2.raw
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctccatcctccctgtctgcatctgtaggagacagagtcaccatcacttgccgggcaagtcagagcaattagcagtactaatttaaagttggtactacgaagaccaaaggaaaacccgaaaggggaaacgaccccccttaaaggaccctttaccctagtaacttcgtaaagttcgtaccttgaccgtaccttacccgttaaggttttacggaaccggtaaaaggggttcccgggggtaccccctaaagtttaccggtaaacggggttttaccgaaggggttcggggaccgttaaaggggtcggggttaaaacgttcccggggttaagggggtaaaccttaagggttaaaccgttttttaccctaaaccccggtttacccgttaacctaaaccccgttaaaccgtttaccaaaacccgttaacgggtttaacctaccgggtaaaccctaaacccgttaaaggtaaaaccgtttacgtttttaaccggtaaacctttaaaacccgtttacctttaaacctacgttaaaccctaaacgtacggtttaacgtttaccctaaaccctttacccccgttaccttaccggtttaacccggtttcccgggggaaacccggggggtaaccgtaaaacggggtcggtaaaacgaaccgtaacggaaaaaccgtaacgttcggtacggtactaccggtaacctaaccgttacg

SEQ ID NO: 347276 - DNA, 688 bp, Homo sapiens
  misc_feature: GZ8MTXP02JLXC2.3.38.D05.1.454.CMB.2.raw
tcagagacgcactccacgaccggtgctcgatttagtatctgatagttgggtttgggggagtcagtctcagtcaggacacagcatggacatgagggtcccccgctcagctcctggggctcctgctactctggctccgaggtgccagatgtgacatccagatcgacccagtcctccactccctccctgtctgcatctgtaggagacagatccaccatcacgttcggaccgggacaagtcaagagactattagcgtagtcttaaatttaagtgtatacgagacgaaacgaaaccggaagggaaaccctacccctaagtccttccgtagtacttctagtcggtctgacctactaccgttagttacgacgtaacggggtccgggtaccctaagtaccggtaaggttcgaggttcgggctaaggggtacgtacgtacgggtacgggaactagtacctttccaccttacccacacgtaacactaaccgtctcgtacaaccgtaacttaaggactttacgttcgaaaccttaacttactacgttactacgtaacttacggttactttacccaaccctttacccgtcttaaccggtcggggtttaccgggggaaccggggaaaccttaggggaccgtaaactacggtaaaacccgtaaacggtcgttaggtaccgacttaccggaccctactttacg

SEQ ID NO: 347277 - DNA, 652 bp, Homo sapiens
  misc_feature: GZ8MTXP02GHEZE.3.38.D05.1.454.CMB.2.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatcgacccagtctccatcctccctgtctgcatctgtaganacagatcacatcacttgccggnaagtcagagcattagcagtcttaatttaaagttggtatcagacaacggaaaccgtaagggaaacctcccctaaagcctacctagtactctatcgctgactatccgtagttcgacgtaaaggtcggtacccagtacgaaggttcgaggtggacgtagggttcggattcgggtagggaactagttacctttcaaccgttctaccaacctactacaaaccgtgtcctagaacctaacgtaggtaacttcgttttacgaaccttaaactttactaccgttataaccctaaagtcgtttaaccgttcccaacccctttacccgttccgtacgtttacccgggtttacggggggaacccggggttacctaaagggggtacgtaacggaaccttaaaccgtaaaacggtacttcggggccgtaccgtacgtaaccc

SEQ ID NO: 347278 - DNA, 558 bp, Homo sapiens
  misc_feature: GZ8MTXP02FQXLJ.3.38.D05.1.454.CMB.2.raw
tcagagacgcactccacgaccggtgctcgatttagtatctgatagttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttattaaattggtatcagcaacaaaccaggaaacgcccctaaagctcctgatctatgctgcatccagtttgacaaacggtggggtccccatcaaggttcaggtgcagtggatctgggacagtattcactctacaccatcaacagtctgaccaacgtgaaagtattttcgactaaactttactacttgtacaaactagtacgtttaccaccttaccccctctacctaccggtttcggggaccgggggtaaccgaaggggtcggaagtactaaccgaaaacgtaaccgttcggtcggtacgtacgaccctacctaacg

SEQ ID NO: 347279 - DNA, 642 bp, Homo sapiens
  misc_feature: GZ8MTXP02JOKP4.3.38.D05.1.454.CMB.2.raw
  modified_base (210)..(210): a, c, t, g, unknown or other
  misc_feature (210)..(210): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
tcagagacgcactccacgaccggtgctcgatttagtatctgatagttgggtttgggggagtcagtctcagtcaggacacagcatggacatgagggtcccccgctcagctccgtggggcctcctgctactctggctccgaggtgccagatgtgacatccagatcgacccagtcctccatccctccctgtctgcatcgtgtaggagacaggntccaccatcacgttcggaccgggacaagtcagagctaattagcagtacttaaatttaagtggtactacagacaacgaaaccgaggaaaccncccctaagctcngatctangctgctatactagttcgagtaacggtcggtcctaagtacgtagtcnggtganaggtcgatcgggaggatagtctttacnctaccacaccataccgtaacnctaccgngaacctaacgttaaggtaacttacttttacggaaactttaacctttaagaccttaagacctaaaacgtagttcctttaaacccacccttacccttaccgttacgtacccggggttaacgggggaccgggtaaacgtaaggggttacggaaacgttaaccgtaaacggaaaacgggtccgttcggtaccggtactaccgtaaccttacccgtaacg

SEQ ID NO: 347280 - DNA, 576 bp, Homo sapiens
  misc_feature: GZ8MTXP02JJTGS.3.38.D05.1.454.CMB.2.raw
  modified_base (221)..(221): a, c, t, g, unknown or other
  misc_feature (221)..(221): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctattaaattgtatcagacaagaaaccaggaaacgcccctaagctcctagatctatgactgcatcctagttcgactaaacggtggggtacccagtacgtaaggttcaggtgggacaggtggatcgtagggacagtattcactctacacatacaacagtctagacaacctagaacgtatttacgactaacttactaactgtacaactagtactttccaacctacccctacttacccgtacggtttaccggggaccgggggtaaccgtaaacggggtacggaacggtaacgtaaccgtaaaacggtaccgtaggttacggcttacggaccgacttaccg

SEQ ID NO: 347281 - DNA, 856 bp, Homo sapiens
  misc_feature: GZ8MTXP02HSSH1.3.38.D05.1.454.CMB.2.raw
  modified_base (208)..(208): a, c, t, g, unknown or other
  misc_feature (208)..(208): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatcgacccagtcctccactccctccctgtctgctatcgtggtagganacgagacgtacacctattccaccgttcgggaccgggtacaacggtccgaagagactaagttacgacgtagtaactttaaagtttaagttaggtactacgacgaacgaaacggaaaaccggaaagggaaacccgtaacccccgtaaagccccgttacccgtaggttaactacgttaacgttcgtacgtaccggtaccttacgtaacccggtttagtttaaccccgggtaaaccgttaaacccggggtttaccggggtaacccgttaaacggtttacccgttaaagggtttaccggtaagggttacgggtaggtaaccgggttaggtaacgtaccggggttaaacgggacccgtttaaggtacccttttaaccacctttacccaaaccctaacctaacggttaacctaaaaccggtcgttacccgtaaacgtaacccgttaaaccggttaacggttaaattttaacgtttaccgaaaccttaaacccgtttaacgtactaacggttaaacctaacgttaacggttacccgtttaccctaaccccgtttaaccctccgtttaaaccggttacccggttacgggggaaaccccgggtaaggtaccggttaggaaccgtaacgtaaccgtaaagtccgagtcgacttcgaacc

SEQ ID NO: 347282 - DNA, 574 bp, Homo sapiens
  misc_feature: GZ8MTXP02FI2RK.3.38.D05.1.454.CMB.2.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctctatcctccctgtctgcatctgtaggagacagagtcaccatcacttgccgggnaaggtcagagcaattagcagctaattaaattgtatcagacaagaaccaaggaaacacccctaaagctcctgatctangcngcactcctagtttagacgaaacggtcggggtacccagtacgaaggttcagtcggctagtgatcgtggaactgtattcactctcacanacaacatcngacacgtagaacttatttacgacttaaacttacgtaactctaacaactagtatttccaaccttacccctactcttaacggtttccggggaaccgggggtaacctaaggggtaggtaaacggattaaaccgaaaaacggtacttacgggtagtacgtaccgaccgtaacccgtaacg

SEQ ID NO: 347283 - DNA, 732 bp, Homo sapiens
  misc_feature: GZ8MTXP02HFNLD.3.38.D05.1.454.CMB.2.raw
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
  modified_base (624)..(624): a, c, t, g, unknown or other
  misc_feature (624)..(624): n is a, c, g, or t
tcagagacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatcgacccagtcctccactccctccctgtctgctatctaggtagganacagtagtccaccatacctacgttcggaccgggacaagtcagagctagtacgcagtacttaattaagtgtancgaagacaaacgaaaccgtaacgggaaacctaccccgtaaagtccctaccgtagtaactaccttagtcgtctacggtactaacgttcctaggtttaccgaaaccggttaaggggtccggtacccagttacgtaaacgggttccgaggtacgggatacgggttacgaggttcgggtagggacttaagttctttaaccnccgttactacccaacgtacaccgtaaacncgttacacgtaaccgtaaaccgttaagtaaacgttttatttacccgaaactttaaccgttacctaacggttactaacgtaaaacgttacccttaacgttaccctaccccgtttacccncgtttaaccggttaccgggtttaccgggggaccgggtaaaccgtacgggttagggaaactaaccgttaaaaccgggtaaacgttacgtcggtacgacgtacgtaaccc

SEQ ID NO: 347284 - DNA, 670 bp, Homo sapiens
  misc_feature: GZ8MTXP02JI6F9.3.38.D05.1.454.CMB.2.raw
  modified_base (201)..(201): a, c, t, g, unknown or other
  misc_feature (201)..(201): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (480)..(480): a, c, t, g, unknown or other
  misc_feature (480)..(480): n is a, c, g, or t
tcagagacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtcctcatcctcctgtctgcatctgtaggagacagngtccaccatcacgttcggccggactaaggtcaaggagtcctagttaacgcaagtctaatttaattggtatcgaagcaaacgaaaccgacgggaaacgccccctaaagtccgtacctcggaatcctagttcgaccgtgacctacgtaccgtagtttacgaccgtaaaggtccggggtaccagtacgtaagttccaaggtgcaggtacgatcgtgggactagtacttctactcgacacgtanacgactacgtancgactaacgtcgaaagttacggtttanaaccttaacgttaacctacgtttaacgactaaacgtacggttaactttacccgtaccttaacccgtcgtaccggtttaccggttaccgggggaacccgggggttaaacaccgggttagggaacgtaaccaaacggtaaaaccgtaaacccggtttggtaaacgggcttaccggtaacgacccgtttaacg

SEQ ID NO: 347285 - DNA, 591 bp, Homo sapiens
  misc_feature: GZ8MTXP01C19EJ.4.30.C08.1.454.CMB.2.raw
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagcggtggtttcgtgtaggctatttagaaggtgtccagtgcgaggtgcagctggtggagtcgtgggggagcttggccaggccgtggggggtccctgagactctcctgtgcncgctcgtgtntctacttactactatgtgtgcgtcggtcgcgcgcgcgagggaggngnggnggtgggcggacgaacaacaaacgaagagtacggagtagacgagtacgtaagtgtgtacgtcgtgtaggacggacgtactacacactactacgacgacgaacgaacgaccgaacgaactactacgtacgtactacgtacggaactaaagtaacgaacgacgacgagacggacgacggacgacgtacgtacgttaattacgttacgttagttagtaagtaagttacgttacgttacgttcgttcgtcgtcgtcggttcgggtccggttcggtccg

SEQ ID NO: 347286 - DNA, 750 bp, Homo sapiens
  misc_feature: GZ8MTXP01AOU3Y.4.30.C08.1.454.CMB.2.raw
tcagagcactgtagcacgaccggtgctcgatttagtctgacgtcaaagggaaaggggctcagagaggagccttagccctggactccaaggcctttccacttggtgatcagcactgagcacagaggactcaccatggaattgggctgagctgggttttccttgttgctatttagaaggtgtccagtgcgaggtgcagcgtggtggagtcgtgggggagtcgttggtccaggtccggtggggggtccctggacgactctcctgtcgcagcctcgtggtacttccacctttactaccttagttggatggacgtcgggtcccgccgaggccgtccggagggggaacgggggcgtggggaggttgggggtacggaaccaaacaagtaaaaccgaaggacgtaggaagtagaaacgtagtactaatgtggactcgtaggtacggaacgggtccgtatttacccgaacctatacccgtaccgaaggaacgaaacccgaaacccggaccaaaacggtaaaccctaccgaaccgttaggttaactaccgttacgggaaactaaaagtaccggaaaaccacggtaaccccgtaaagggaccggaaccccgggaaaggtaacccgtaacgggttacctttaaagttttaaacgttacgttaggttaggttaaacggtaaaaggtaacgttaacgtttcggtttaccgttaacgtacgttccgtcggggtcgggggttcccttcggggcccttaaccccggg

SEQ ID NO: 347287 - DNA, 571 bp, Homo sapiens
  misc_feature: GZ8MTXP01CSUIL.4.30.C08.1.454.CMB.2.raw
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggtttcctgttgctattttagaggtgtccagtgcgaggtgcagctggtggagtcgtgggggagcttggtccagccgtggggggtccctgagactctcctgtgcagcctctggattcacctttactacctatggatggactgggtccncaggctcgagggagggctggngtgggngccanataaacagatggaagtgaacagtactaatgtggactcgtggtgaagggcctattccacctatcctaccaagacgaacaacgccaaagactcactgtactctagggacaaagtgaaacagccctagacgacgcccggtaaggaccacgggtcttaagtttaacttacgtggttagtaagaaagttacgttaacgttggtttaacttagaattccgtggttcgggggtcccgttgggtcccc

SEQ ID NO: 347288 - DNA, 564 bp, Homo sapiens
  misc_feature: GZ8MTXP01ER14B.4.30.C08.1.454.CMB.2.raw
  modified_base (300)..(300): a, c, t, g, unknown or other
  misc_feature (300)..(300): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (470)..(470): a, c, t, g, unknown or other
  misc_feature (470)..(470): n is a, c, g, or t
  modified_base (491)..(491): a, c, t, g, unknown or other
  misc_feature (491)..(491): n is a, c, g, or t
  modified_base (541)..(541): a, c, t, g, unknown or other
  misc_feature (541)..(541): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagcgtggtggagtcgtgggggagcttggtccagccgtgggggtccctgagctctctgtgcagcctctggattcacctttacaccttatggatggactgggtccnccaggcctccgaggggagggctgggaggtgggtggaccaaacaactaaaaccgaagagtaggaagtagaacgagtactaaagtgtggactgtggtagaacggggccagttacaccattcacagacgacaacgccaaanacacactntatcgagaactaatacgaacagcngacgacgacgaggactacgtntttaagttattacgtggttagaagaaagttagttacgttcgttctacgtntcgtcggttcggtcggttcgtcg

SEQ ID NO: 347289 - DNA, 733 bp, Homo sapiens
  misc_feature: GZ8MTXP01AZINO.4.30.C08.1.454.CMB.2.raw
  modified_base (619)..(619): a, c, t, g, unknown or other
  misc_feature (619)..(619): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagcttgggttttccttgttgcttattttagaaggtgtccagtgcgaggtgcagcgtggtggagtcgtgggggagcgttggtccagccgtcgggggtccctgacgtactctccgtgtcgcacgtcctcgtgtattccgtacctttactaccttagttggtagtggaccgttcgggcccgccgaggcctccggaggggacgggcgtgggagtgggggtacgaaccaaacgtaagtaaaaccgaaaggtacgtaaggaaagttaggaaacgtagtaacgttaagtacggtggtacgttcgtagggtacggtaacggggtaccctacgttcccgaaccctagttacccaccgaagaaccgaacaaaacccgaccgaaacgtaaccttcaacgttagtaacttcgtacgaacgtaaaacgtacgaaacgtacgtaccgtagaacggaacgaccgggaaggaccgttaaaccgggttntttaatttttaacgttaccggtttagttacggtaaagtaaaaggttcgttaacggtttcgggtttcctacggtaacgttccggtacgggttccggggtccgttaacgggtcccc

SEQ ID NO: 347290 - DNA, 556 bp, Homo sapiens
  misc_feature: GZ8MTXP01CV55B.4.30.C08.1.454.CMB.2.raw
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggaggcttggtccagccgtggggggtccctgagactctcctgtgcagcctctggattcaccttactactatgatgactggcncaggctcgagggagggctggagtgggtgcaaagataaaacagatggaagtgaacagtactaatgtgactctagtagagggcctatcaccatctcaganaacaacgaccaaagaactcaactgaatctggacaaaatgaaacngcccagagaacgccgaagggtacaccggnttaatttattactgttgtaaagaaagttaagttagttcgggtttaactacgtaagttcccgtggttcgggggtccgttcgggtaacccc

SEQ ID NO: 347291 - DNA, 639 bp, Homo sapiens
  misc_feature: GZ8MTXP01BC5JG.4.30.C08.1.454.CMB.2.raw
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagtcgttgggttttccttgttgcttattttagaaggtgtccagtgcgaggtgcagctggtggagtcggtgggggagtcttggtccagccgtgggggtccctgacgtactcgtcctgtgcagcctgtggacttcacctttactactatggatggactggtccncgagctcgagggaggctggagtgggngaccaanaataaaccagagtggaaagtagaacgtagtactaagtgtgactcgtaggtacggacggccgtattaccgactattccacagaacgacaaccgacaaagacctcacttgtaatcgtaggaactaaagtcgaaacgacgcctaggacggaaccgaccggaaacggaccgtaaccggttcttaaagttttaacgttccgtagggttaacgtaaaggtaaaggttaacgttaacgttcgggttttcctacggtaacgtttcccggtcggggtttacgggggcccgtttcggggtaaccccg

SEQ ID NO: 347292 - DNA, 400 bp, Homo sapiens
  misc_feature: GZ8MTXP02HD2SW.4.30.C08.1.454.CMB.2.raw
  modified_base (396)..(400): a, c, t, g, unknown or other
  misc_feature (396)..(400): n is a, c, g, or t
tcagagcactgtagcacgaccggtgctcgattagtctgacgtcaagggaaggccacctctcctgcagggccagtcagagtgttagcaacagctacttagcctggtaccagcagaaacctggccaggctcccaggctcctcatctatggtgcatccaccagggccactggcatcccagacaggttcagtggcagtgggtctgggacagacttcactctcaccatcagcagactggagcctggagatttgcagtgtattactgtcagcagtatggtagttggaagacgttcggccaagggaccaagggtggaaatcaaacgaactgtggcctgcaccatctgtcttcatcttccgcatctgactacagtgctctgagcgggctggcaaggcgcatagnnnnn

SEQ ID NO: 347293 - DNA, 596 bp, Homo sapiens
  misc_feature: GZ8MTXP02G3ZLL.4.30.C08.1.454.CMB.2.raw
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggaggcttggtccagccgtgggggtccctgagactctcctgtgcagcctctggattccacctttactacctattggatggactgggtccgccaggctccgaggggagggctggaggtggggtgaccaaacaataaaccaagataggaagtgaacagtactagtgtggactctggtagaacggggccgattccaaccctattccctacccaaggaacgaaccaaaccgcccaaagaaacctcaacttgtaatcctagactaaaatgaaacagcctagagacgcccgaaggaccacggtcttaaagtttataacgtgtagtaggaaaagtacgtaaacgtttggttaacttacgagttcctcggtcgggggtcccgtgggcccc

SEQ ID NO: 347294 - DNA, 613 bp, Homo sapiens
  misc_feature: GZ8MTXP02GO58X.4.30.C08.1.454.CMB.2.raw
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggaggcttggtccagccgtggggggtccctgagactctcctgtgcagcctctggattcacctttactacctattggatggactgggtccgccaggcctccgaggggaaggggctgggaggtgggtcggaccaaacaataaaaccaagataggaagtgaaacagtactagtgtggactctggtagaagggccgattccgaacctatcctccaagagaaccaaacgccaaaagaacctcgactgtatctagacaaaatgaaacacgacctgaagacgacccgaggaaccacgggtacttaagtttaattacgtagtaggttaaaggaaaacgtaagtaaaccgtttgggtttaaccttacgtaacgttccgtacgggtcgggggcccgttcggggtacccc

SEQ ID NO: 347295 - DNA, 656 bp, Homo sapiens
  misc_feature: GZ8MTXP02JZDI6.4.30.C08.1.454.CMB.2.raw
  modified_base (513)..(513): a, c, t, g, unknown or other
  misc_feature (513)..(513): n is a, c, g, or t
  modified_base (571)..(571): a, c, t, g, unknown or other
  misc_feature (571)..(571): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagcttgggttttccttgttgcttattttagaaggtgtccagtgcgaggtgcagctggtggagtcgtgggggagtcgttggtccaggccgtggggggtccctgacgctctcctgtcgcagcctctggacttcctacctttactaccttagttcggatggacgtgggtcccgccaggctccggaggggaggggcgtgggaggtggggtcggacccaaacaaagtaaaaccgaaaggtagtagggaaagtcgaaactaggtactagtggtgggacttcgtggtaggaacgggggtcctattcccaaccgtacttccctaccgaagaacgaaccaaccgaccaaagacctcactgtaatctagactaaancgaacacgcctaggacgacggaccgaaggaccgtacgtactttaagtttacgttacgngggttagtaaaggaaaagtacgtaaacgtttcggttccgttacgtacgttccgttacgggtccgggggttcccggtcgtaccccg

SEQ ID NO: 347296 - DNA, 751 bp, Homo sapiens
  misc_feature: GZ8MTXP02HRJ5A.4.30.C08.1.454.CMB.2.raw
  modified_base (308)..(308): a, c, t, g, unknown or other
  misc_feature (308)..(308): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggagcgttggtccagccgtggggggtccctgagactctcctgtgcagcctctggacttcctacctttactacctattggatggactcgggtccncgaggctccgaggggaggggctggaggtgggtggaccaaagaataaaaccgaagagtagggaagtagaacagttactagtaggtcgggtacttcgtaggtacggaaacgggggtcccgtaatttacccaacccgtacttccctacccgaaggaaccgaaacccgaaaacccggacccccaaaaaggtaaaccccttccgaaaccgtttacggttaaacttcccgttagaaccctaaaagttacggaaaaccctacggaccccgtaaggaacggaacgcccggggaaacggaaccgtaaccggggttaccttttaaaaggttttactttaaccggtaggttaagggtaaacggtaaaacggtacggttaaaccgtttggggtttaacccttggaaaccgttttccggtaccgggtttccggggggacccgtttcggggaccccc

SEQ ID NO: 347297 - DNA, 610 bp, Homo sapiens
  misc_feature: GZ8MTXP02FX9TR.4.30.C08.1.454.CMB.2.raw
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgcttattttagaaggtgtccagtgcgaggtgcagcgtggtggagtcgtgggggagcttggtccagccgtgggggtccctgagactctcctgtgcagcctntggattcacctttactacctatgatggactgggtccnccaggctccgaggggagggctgggaggtgggtgaccaaacactaaaccaaggagtaggaacgtagaaacagttaactagtggtgggactcgtaggtagtaacgggggtctattccaccgtatacctaccgaagacgaaccacgacccaaagacctcaactgtactctagactaaagtcgaaacagtacccgagacgacggaccggaggtaacaacggtcttaagttttactaggttgtaggtaacgaaaagtacgtacggttggttaaccttcggaacttccgtacggtcgggggtctcgggtacccg

SEQ ID NO: 347298 - DNA, 606 bp, Homo sapiens
  misc_feature: GZ8MTXP02IJBDS.4.30.C08.1.454.CMB.2.raw
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggagcttggtccagccgtgggggtccctgagactctcctgtgcagcctctggattcacctttactacctattggatggactcgggtccgccgaggcctccgaggggaaggggctgggagtggggtcggaccaaacgaactaaaccgaagagtaggaagtagaacagtactagtgtggactcgtgtagaacggggccgaattccgaacctatcctaccgaaggactaaccaaacggacccaaaagaacctccgaaacttcgtaattaccgtagaactaaaagtcgaaaaccgagccgtaggaacgacgacccggaagaccgacggtacttaagtttactacgtgtagtacgaaagacgtaactggttaactgactcgtagtcgggcctggccg

SEQ ID NO: 347299 - DNA, 602 bp, Homo sapiens
  misc_feature: GZ8MTXP02G5UNI.4.30.C08.1.454.CMB.2.raw
  modified_base (303)..(303): a, c, t, g, unknown or other
  misc_feature (303)..(303): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggagcttggtccaggccgtgggggtccctgagactctcctgtgcagcctctggattccacctttactactattggatggactgggtccnccgaggcctcgaggggaaggggctgggaggtggggtcggaccaaacaagtaaaaccaagagtaggaagtagaacagtactatgggtggtactctggtaggaaacgggtccgaatttccgaacccattacctcccaaaggacgaaaccaaaaccggccaaagaaccttcgacttgtatccgtagactaaaatgaaacctagccctaggacgacgacccgaggaccacggtacttagtttatacgtgtagtacgaaagacgtaacttggtctttcgattccgtggcgggccttggaccccg

SEQ ID NO: 347300 - DNA, 582 bp, Homo sapiens
  misc_feature: GZ8MTXP02J0KXR.4.30.C08.1.454.CMB.2.raw
  modified_base (376)..(376): a, c, t, g, unknown or other
  misc_feature (376)..(376): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagcgtggtttcctgttgctatttagaaggtgtccagtgcgaggtgcagctggtggagtcgtgggggagcttggtccaggccgtgggggtccctgagactctcctgtgcagcctctggattcacctttactacctattggatggactgggtccgcaggctccgagggaggggtctgggagtgggtggaccaacactaaaccgaagatagggaagtagaacagtacagtgnggactcgtgtgaacgggtccgtattccgacctatcctacaccgagaacccaacgacccaagaacctcaactgtaatctagactaaatacggaaacacgcctaggaacggacggccgaggtacacggtacttatttagtacgtaggttagagaaagacgtaacgttcggttcttacgagttccgtacggtcggggccgttgaccccg

SEQ ID NO: 347301 - DNA, 595 bp, Homo sapiens
  misc_feature: GZ8MTXP02JRU1P.4.30.C08.1.454.CMB.2.raw
  modified_base (431)..(431): a, c, t, g, unknown or other
  misc_feature (431)..(431): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgcttattttagaaggtgtccagtgcgaggtgcagcgtggtggagtcgtgggggagcgttggtccagccgtgggggtccctggagactctcctgtgcagcctctggattcacctttacacctatggatggactcgggtccgccaggctccggaggggaggggctgggaggtggggtcggaccaaacaataaaccaagagtaggaagtagaacagttactagtgtggactcgtggtagagggcctattcaccatccacagacacaacnccaaagactcatgtaactcctagacaaatcgaaacgagcccgtaggacgacggaccgtaacggacgtacggtctttaaagtttacttacgtggttagtagaaaagacgtaaagttcggttaacctagtaacgtcgttcgggtacggggtccgtacggtaccccg

SEQ ID NO: 347302 - DNA, 753 bp, Homo sapiens
  misc_feature: GZ8MTXP02FISKT.4.30.C08.1.454.CMB.2.raw
  modified_base (315)..(315): a, c, t, g, unknown or other
  misc_feature (315)..(315): n is a, c, g, or t
tcagagcactgtagcacgaccggtgctcgatttagtctgacgtcaaagggaaaggggctcagagaggagccttagccctggactccaaggcctttccacttggtgatcagcactgagcacagagactcaccatggaattgggctgagctgggttttccttgttgcttatttagaaggtgtccagtgcgaggtgcagcgtggtggagtcgtgggggagtcgttgggtccaggccggtggggggtccctggagactctcctgtgcagcctcgtggacttccacctttactacctagttggaatcggactcgggtccnccaggctccggaggggaagggctgggaggtggggtcgaccgaaacaacgtaaaaccgaggtaacgtacgggaaaagttacgaaaacgtaggttaacttagttaggttacggggacccttagggttagggttaacggggaaaccgggggtaccggtaaactttaccccgaaacccgtatttaccccgtacccgaaaaggaacggaaaacccgtaaaacccggacccgaaaaacggtaaaccctttacaaaacccgttggttaaaactccctaaggaacctaaagtacgaaaccgagtaccccgtagaacggaacggtccggaacggaacaccgggtacttaaacgtttacttagtacgtaggtaaagaaaacgtacgtaaccgtttgggttaacttaccgtaagttccgtcggtacgggggacccgttcggaaccccgg

SEQ ID NO: 347303 - DNA, 606 bp, Homo sapiens
  misc_feature: GZ8MTXP02GD3Y4.4.30.C08.1.454.CMB.2.raw
  modified_base (306)..(306): a, c, t, g, unknown or other
  misc_feature (306)..(306): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagcttgggttttccttgttgctattttagaaggtgtccagtgcgaggtgcagctggtggagtcgtgggggaggcgttgggtccaggccgtggggggtccctgagactctcctgtgcagcctctggattcacctttactacctatggatggactggtccncaggctccgaggggaggggctgggaggtggggtcgaccaaacaataaaaccgaagataggaagtgaaacagtactatgtggactcgtggtagaacggggtccgtattccaacccacgtacctaccgaacgaacgaacccaaaccgacccaaaagaaacctacaccttgtaactctagaacaaatacgaaacagaccagagacgaccggaggacacgtacttaatttattactagtagtaagaaaagtaacgtacgttggttaacgttacgaacttcgtcggtcgggggccgttggacccg

SEQ ID NO: 347304 - DNA, 637 bp, Homo sapiens
  misc_feature: GZ8MTXP02H7I7M.4.30.C08.1.454.CMB.2.raw
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
tcagagcactgtagcacgaccggtgctcgattttagtctgacgtcaaagggaaaggggctcagagaggagccttagccctggactccaaggcctttccacttggtgatcagcactgagcacagaggactcaccatggaattggggctgagcttgggttttccttgttgcttattttagaaggtgtccagtgcgaggtgcagctggtggagtcgtgggggagtcgttggccgagccggtgggggtccctgagctctcctgtgcngcctntgctctacttactactatgntggctcggcncgagcctcgagggaggctggaggtgggtcgacaaanaactaaaaccaganacggaagtagaacagtatagngtcgtactctaggtagaacgggccgtatacccgaaccctagtcctacccgaaggtacgaaacccgtaaacggaccaaagaaccctctaccgtagtaaccttcgtaacgaaaccttaaagacgtaaacgcgtacccgtaaggaccgaggacccgggaagtaccgtaacggtactttaagtttacgttagtcgttaaggtaacgaaaagtacgttaacgttcggtttaaccttcgaacgtttcgtacggtcgggtaccgttcgtaccccg

SEQ ID NO: 347305 - DNA, 648 bp, Homo sapiens
  misc_feature: GZ8MTXP02JDI0V.4.30.C08.1.454.CMB.2.raw
  modified_base (338)..(338): a, c, t, g, unknown or other
  misc_feature (338)..(338): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagctgggttttccttgttgctattttagaaggtgtccagtgcgaggtgcagctggtggagtcgtgggggaggcgttggtccagccgtggggggtccctgagactctcctgtgcagcctctggtatcctacctttactacctagttggatcggactggtccgcgaggctcgagggagggcgtggaggtgggngaccaaacataaaccaagataggaagtagaacagtactagtgtggtactcgtgtaggaagggcctattccgaaccctatcccgtaccgaagacgaaccgtaaaccgacccgaaaagtaaccctcaaccttaggttactcctacggaactaaaagtcgaaacgtacgaccgtaggacggacgacccggaggaacgacggtactttaatttacgttacgtggttaagtaagtaaaacggtacggttaaaccgtttgggtttaacctagtacttcccgggttaggtccgggggtacccgttcggtaacccccg

SEQ ID NO: 347306 - DNA, 545 bp, Homo sapiens
  misc_feature: GZ8MTXP02GM2FV.4.30.C08.1.454.CMB.2.raw
  modified_base (266)..(266): a, c, t, g, unknown or other
  misc_feature (266)..(266): n is a, c, g, or t
  modified_base (382)..(382): a, c, t, g, unknown or other
  misc_feature (382)..(382): n is a, c, g, or t
  modified_base (490)..(490): a, c, t, g, unknown or other
  misc_feature (490)..(490): n is a, c, g, or t
tcagagcactgtagcacgaccggtgctcgatttagtctgacgtcaaagggaaaggggctcagagaggagccttagccctggactccaaggtctttccacttggtgatcagcactgagcacagaggactcaccatggaattggggctgagctgggttttccttgttgctattttagaaggtgtccagtgcgaggtgcagctggtggagtcgtgggggaggcttggtccaggccgtggggggtccctgagactctcctgtgcagcctntggattcacctttactacctattggatggactgggtccgccagggctccgaggggaaggggctgggagtggggtggccaaacataaaaccaagatggaagtgaacagtactattgnggactctgtgaagggcccgattcaccatcctacagacgaacaaacgccaaacgaaactcaaactgtaatctagacaaatgaaacagcctgagagccgagacaacggtntacttatatgtagagaagacgtacgttggttctacgtatcgtcgtcgggcgtcgc

SEQ ID NO: 347307 - DNA, 676 bp, Homo sapiens
  misc_feature: GZ8MTXP02GU6YD.4.30.C08.1.454.CMB.2.raw
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
tcagagcactgtagcacgaccggtgctcgatttagtctgacgtcaaagggaaaggggctcagagaggagccttagccctggactccaaggcctttccacttggtgatcagcactgagcacagaggactcaccatggaattggggctgagcgtgggttttccttgtgctattttagaaggtgtccagtgcgaggtgcagctggtggagtcgtgggggagcgttggtccaggccgtgggggtccctgacgactcctctgtncagcctcnggtattcacctttactaccttattggatggacgtcgggtcccgccaggcctccggaaggggaggggccgtgggaggtggggtacggaccaaacaagtaaaaccaaggtagtagggaagtagaaacagttactaagtgtagggtactcgtaggtacgaacggggccgtaacttcccaaccgtacttcccaaccgaaggaacaaacccgaaaacgacccaaaagtaaccctacgtactacgttataccgtagaactaaaacgtagaaacacgaccttaggaacgacggaaccgaggaaccgtacgtaacctttaagtttaacttacgtgggtacgtaaacgtaaaagtacgttaacgtttgtttccgttaacggtcttccggtccggttcggggtcccggtacggtccccg

SEQ ID NO: 347308 - DNA, 538 bp, Homo sapiens
  misc_feature: GZ8MTXP01D7KM9.15.86.H09.1.454.CMB.2.raw
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttggggacttccctggtctccttctacctactgcccttcatttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaaggggacggatccccgatcgcttcatgggctccagttctgggggctgaccgctacctcaccatctccaacctccagtctgacgatgaggctgagtatcactgnggagagagccanacaaattgaatgggacccaaaggggacggggtttggggtgttcgggcggagggccaaggctgaccgtcctagggcaagcccaaggccttcgccccctggcnccttctcgttccccaaccctccncgctaacgttgaaccg

SEQ ID NO: 347309 - DNA, 524 bp, Homo sapiens
  misc_feature: GZ8MTXP01CAEYC.15.86.H09.1.454.CMB.2.raw
  modified_base (328)..(328): a, c, t, g, unknown or other
  misc_feature (328)..(328): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
  modified_base (494)..(494): a, c, t, g, unknown or other
  misc_feature (494)..(494): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagtttcnggggctgaccgctacctccaccatctcccaacctccagtctgacgatgaggctgagtatcactgngganagagccanacaattgatgggccaaaggggcggtttggggnttcgggcgagggaccaagctgaccgtcaggcaagcccaaggcttgccccctggttcncttctgtccccgcctctcgctaacgttgcg

SEQ ID NO: 347310 - DNA, 527 bp, Homo sapiens
  misc_feature: GZ8MTXP01EHKB6.15.86.H09.1.454.CMB.2.raw
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttctgggggctgaccgctacctccaccatctccaacctccagtctgacgatgaggctgagtatcatgtgganagacgccaanacaattgatgggaccaaagggggcgggtttggggtgttcgggnggagggaccaagctgaccgtctaggcaagcccaggcttcgcccctggcncttctcgtccccncctcncgctaacgttgcg

SEQ ID NO: 347311 - DNA, 579 bp, Homo sapiens
  misc_feature: GZ8MTXP01D6H9F.15.86.H09.1.454.CMB.2.raw
  modified_base (304)..(304): a, c, t, g, unknown or other
  misc_feature (304)..(304): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttggggaagaggaagactgacggtccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaagggctggagtgggttggacgtttcaaaagtaaaatgatggngagaaaatagactacggtgcaccgtgaaaggaagattcaccatctacaagagaataaattacaaaaaacgacggtgtatttgacaaaatgaacagacctagaaaccgaggacacagccgtctattactgtaccacagattcggaagtgcatcgaacgtaaaggaggctatggtcttttgatatcgtggggcccagggacaagtggtcgtcgtctcttcagccttccaccgaagggcccnttccggtcttccccctggccacccttcctccaagcg

SEQ ID NO: 347312 - DNA, 523 bp, Homo sapiens
  misc_feature: GZ8MTXP01C8NEA.15.86.H09.1.454.CMB.2.raw
  modified_base (327)..(327): a, c, t, g, unknown or other
  misc_feature (327)..(327): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttgggggacttccctggtctccttctacctactgcccttcattttctccacaggcctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttcnggggctgaccgctacctccaccatctccaacctccagtctgacgatgagctgagtatcactgnggagagagccanacaattgatggaccaaggggcgggttggggngttcgggnggagggaccaagctgaccgtcaggtcaagcccaggccttgccccctggttcncttctgtccccgccttcncgctaacgngcg

SEQ ID NO: 347313 - DNA, 568 bp, Homo sapiens
  misc_feature: GZ8MTXP01ADUA3.15.86.H09.1.454.CMB.2.raw
  modified_base (442)..(442): a, c, t, g, unknown or other
  misc_feature (442)..(442): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctggggagccttggtaaagcctggggggtcccttagagtctcctgtgtggcctctggattcactttcagtaatggctggatgagttgggtccgccaggctccagggaaggggctggagtgggtggacgtttcaaaagtaaaatgatggtgagaaaatagactacggtgcacccgtgaaaggaagattcaccatctacaagagaataattacaaaaacgacggtagtatttgacaaatgaaacagacctagaaaccgaggacacagccgtatattactgtaccanagattcggaatgcatcgacgtaaagngctanggtnttgtntatntggccgaggacgaagtgtcgtcgtctctcttacgcttccaccaacggccgcttcgtcctcccgtcgcccnccncctcgcgcg

SEQ ID NO: 347314 - DNA, 535 bp, Homo sapiens
  misc_feature: GZ8MTXP01ENH7A.15.86.H09.1.454.CMB.2.raw
  modified_base (502)..(502): a, c, t, g, unknown or other
  misc_feature (502)..(502): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctgggggctgaccgctacctccaccatctccaacctcccagtctgacgatgagggctgagtatcactgtggagagagccaacacaaattgaatgggaccaaggggacggtttggggtgttcgggcggagggaccaagctgaccgtctagcaagcccaaggcttcgcccctggttcncttctcgttcccaaccctctcgctaacgttgcg

SEQ ID NO: 347315 - DNA, 569 bp, Homo sapiens
  misc_feature: GZ8MTXP01ENJBV.15.86.H09.1.454.CMB.2.raw
  modified_base (533)..(533): a, c, t, g, unknown or other
  misc_feature (533)..(533): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctgggctgaccgctacctccaccatctcccaacctccagtctgacgatgaggctgagtatcactggtggagagacgccaacacaaagttgaattacgggacccaaagggggtacggggtttgggggtcgtttcggggcgggaaggggacccaaaggtccgtgtacccgtcctagggtcaacgcccaaagggcttcgccccctggttcncttctcgttccccaacctcctcgctaacgttgaacg

SEQ ID NO: 347316 - DNA, 619 bp, Homo sapiens
  misc_feature: GZ8MTXP01EO0RK.15.86.H09.1.454.CMB.2.raw
  modified_base (414)..(414): a, c, t, g, unknown or other
  misc_feature (414)..(414): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacgggatccccgatcgcttcatgggctccagttcgtgggggctgaccgctacctccaccatcctccaaccctccagtctgacgatgaggctgagtatcacgtgtggagagacgccaanacaaattgaatgggaccctaaagggggtacggggtttggggtagttccggggacgggaaggggaacccaaggcctacgggacccgttccgtaaggggtccaacggaccccgaaaggggcccttcgggcccccccttcgggccttaccttcccgttaacggttcccccaaccccgttccctccggaccttaacggttaacgaaccg

SEQ ID NO: 347317 - DNA, 551 bp, Homo sapiens
  misc_feature: GZ8MTXP01B35RE.15.86.H09.1.454.CMB.2.raw
  modified_base (410)..(410): a, c, t, g, unknown or other
  misc_feature (410)..(410): n is a, c, g, or t
  modified_base (501)..(501): a, c, t, g, unknown or other
  misc_feature (501)..(501): n is a, c, g, or t
  modified_base (515)..(515): a, c, t, g, unknown or other
  misc_feature (515)..(515): n is a, c, g, or t
  modified_base (536)..(536): a, c, t, g, unknown or other
  misc_feature (536)..(536): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatggctcagttcgtggggctgaccgctacctcccaccatcctcccaacctaccagtctgacgatgagctgagtatcactggtggagagagccaanacaattgatgggacccaagggggtacggggtttggggtcgttcggggacgggagggaccaaggctgacccgtctaggcaacgcccaggccncgcccctggttccncttcctcgtccccaacctccncgctaacgttgaacg

SEQ ID NO: 347318 - DNA, 543 bp, Homo sapiens
  misc_feature: GZ8MTXP01EB552.15.86.H09.1.454.CMB.2.raw
  modified_base (331)..(331): a, c, t, g, unknown or other
  misc_feature (331)..(331): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (506)..(506): a, c, t, g, unknown or other
  misc_feature (506)..(506): n is a, c, g, or t
  modified_base (512)..(512): a, c, t, g, unknown or other
  misc_feature (512)..(512): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccgagtttcgngggggctgaccgctacctccaccatctccaacctccagtctgacgatgagctgagtatcactggngagagagccaanacaattgaatcgggaccaagggggtcgggtttggggtgtcgggnggaggaccaagctgaccgtctaggcaacgccgaggccttcgccccctggttccncttccncgttccccaacccttcncgactaacgttgcg

SEQ ID NO: 347319 - DNA, 631 bp, Homo sapiens
  misc_feature: GZ8MTXP01EWMTY.15.86.H09.1.454.CMB.2.raw
  modified_base (430)..(430): a, c, t, g, unknown or other
  misc_feature (430)..(430): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccagggacgtcccccagtatataatagaaagtaagagtgatggcagaccacgaccggaagggggacgggactccccgatcgcttcagtcgggctccgtagttcgtgggggctcgaccgctacctcccaccactcctacccaaccctccagtctgacgagtgaggctagtagtatcgatggaggagagacgcccaanacaattgatggaccgaagggggtacggggtttggggacggttcgggacgggaacggaccaaggccgtacggaacccgtctagggccaacggtaccccgaaggggcccttccggccccccgttcgggttccttacctttcccgttccggttcccccctaacccgttcccgtaccggttacgttaaccgggttaacgaaccgg

SEQ ID NO: 347320 - DNA, 518 bp, Homo sapiens
  misc_feature: GZ8MTXP01CT5IH.15.86.H09.1.454.CMB.2.raw
  modified_base (264)..(264): a, c, t, g, unknown or other
  misc_feature (264)..(264): n is a, c, g, or t
tcagtctacgtagccacgaccggtgctcgatttagtgctatagacttgggtttggggacttccctggtctccttctacctactgcccttcattttctccacaggtctctgtgctctgcctgtgctgactcagccccgtctgcatctgccttgctgggagcctcgatcaagctcacctgcacctaagtagtgagcatcgaacctacacatcgaatggtatcaacagagaccagggaatccctcagtatataatgaaagttagagngatggcagccacaccgaagggggacggatccccgatcgcttcatgggctcagtctgggctgaccgctacccctcacatcctccaaacctcaagtctgacgatgagctgagtatcatgtggagagagccacacaaattgaatgggaccaaaggacgggtttgggtggttcgggcggagggaccaaagctgaccgtcaggtcagcccaaggctcgccccttggttcactctcgtcccgcctcttcgtcttaacgtg

SEQ ID NO: 347321 - DNA, 628 bp, Homo sapiens
  misc_feature: GZ8MTXP01AIJW6.15.86.H09.1.454.CMB.2.raw
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctgggatgagttgggtccgccaggctccgagggaaggggctggagtgggttggacgtttacaaaagtaaaatgatggtagaagaaatagactacggtgcaccgtagaaaggagattcaccatcgtacgaagagtaataaattacaaaaacgacggtagtatttagacaaatagaacagaacctaagaaaccgaggaacacacgccgtactattactgtaaccacaagtattaccggaaagttgacaagtaccggaaacgtaaagggagtcttaagttgggtcttttaggattaagtcgtgggggcccaaggggacaagtcgggtactcggtctctcagcccttcacgaagggccccagttccggtcctccccgtgcccacccgttcctcgaagcg

SEQ ID NO: 347322 - DNA, 724 bp, Homo sapiens
  misc_feature: GZ8MTXP01DRF6V.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacgaccgaagggggacggactccccgatcgcttcagtggctccgtagttcgtgggctcgaccgctacctccaccatcctaccacctccagtctgacgatgagctgagtactcacgttggacggagacgaacgacccaaactaacgtaaagttggaacgttacggggacccgtaaaaggggggttccgggggttttgggggtacggttaccgggggacggggaacggggaacccgtaaaggtcccgttacggtaaccccgggttaccgtaacgggggtcccaaaccgggccccgttaaacgggggtccccttaccccgggtacccccccccgtttcggggttaccccttaccccgtttcccgtttccccgggttttaacccccccccctaaccccggtttcccgtaccggttacccgtttaaccgggttaacggtaaccgg

SEQ ID NO: 347323 - DNA, 547 bp, Homo sapiens
  misc_feature: GZ8MTXP01B772F.15.86.H09.1.454.CMB.2.raw
  modified_base (141)..(141): a, c, t, g, unknown or other
  misc_feature (141)..(141): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtntgcatctgccttgctgggagcctcgatcaagctcacctgcaccctaagtagtgagcatcgaacctacaccatcgaatggtatcaacagagaccagggaatccctcagtatataatgaaagttagagtgatggcagccacaccgaagggggacggatccccgatcgcttcatgggctcgagttctggggctgaccgctaccctcacatccnccaaacctcngtctgacgatgaggctgagtancactggtggagagacgccaacacaagttgaatcgggaccgaagggtacgggtttggggtcggttcgggcgggaggggacccaaggctcggaccgtcgtaggtcacgcccaaggctcggcccccttggttcacgtctcgtccccgcctccttacgcttcgtaacg

SEQ ID NO: 347324 - DNA, 531 bp, Homo sapiens
  misc_feature: GZ8MTXP01B7IMZ.15.86.H09.1.454.CMB.2.raw
  modified_base (396)..(396): a, c, t, g, unknown or other
  misc_feature (396)..(396): n is a, c, g, or t
  modified_base (503)..(503): a, c, t, g, unknown or other
  misc_feature (503)..(503): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttctgggggctgaccgctacctccaccatctccaacctccagtctgacgatgaggctgagtatcactgtgganagagccaacacaaattgaatgggacccaaagggggacgggtttggggtgttcgggcggagggaccaagctgaccgtcaggtcaagcccaaggcttgcccctggttcncttctcgtcccgcctctcgctaacgngc

SEQ ID NO: 347325 - DNA, 525 bp, Homo sapiens
  misc_feature: GZ8MTXP01BLM6A.15.86.H09.1.454.CMB.2.raw
  modified_base (406)..(406): a, c, t, g, unknown or other
  misc_feature (406)..(406): n is a, c, g, or t
  modified_base (497)..(497): a, c, t, g, unknown or other
  misc_feature (497)..(497): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttctggggctgaccgctacctccaccatctccaacctccagtctgacgatgaggctgagtatcactggtggagagacgccaanacaaattgatgggaccaaggggacggtttggggtgttcgggcggagggaccaagctgaccgtctaggcaagcccaggccttgcccctggcncttctcgtcccgcctcncgctcgttgcg

SEQ ID NO: 347326 - DNA, 557 bp, Homo sapiens
  misc_feature: GZ8MTXP01CY20A.15.86.H09.1.454.CMB.2.raw
  modified_base (329)..(329): a, c, t, g, unknown or other
  misc_feature (329)..(329): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (489)..(489): a, c, t, g, unknown or other
  misc_feature (489)..(489): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggatccccgatcgctcatgggctccagttcnggggctgaccgctacctccaccatctccaacctccagtctgacgatgagctgagtatcatgnggagagagccanacaattgatggaccaaggggtacgggttgggtagttcgggcggagggaccaagcgtgacccgtcgtaggtcaacgcccgaaggtcnccggtccccctggttccttaccttcctcgttcccccncccttcctccggttactaacggttcgtaacg

SEQ ID NO: 347327 - DNA, 538 bp, Homo sapiens
  misc_feature: GZ8MTXP01DFYO8.15.86.H09.1.454.CMB.2.raw
  modified_base (330)..(330): a, c, t, g, unknown or other
  misc_feature (330)..(330): n is a, c, g, or t
  modified_base (405)..(405): a, c, t, g, unknown or other
  misc_feature (405)..(405): n is a, c, g, or t
  modified_base (502)..(502): a, c, t, g, unknown or other
  misc_feature (502)..(502): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagtttcgnggggctgaccgctacctccaccatctccaacctccagtctgacgatgaggctgatatcatgtggagagagccaanacaaattgatgggccaaaggggtcgggttgggtgttcgggcgggagggaccaaggctgacccgtctaggcaagcccaaggccttcgccccctggccncttcctcgttccccgcctcctcgctaacgttgaacg

SEQ ID NO: 347328 - DNA, 635 bp, Homo sapiens
  misc_feature: GZ8MTXP01EJCL8.15.86.H09.1.454.CMB.2.raw
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctccgagtttcgtggggctcgaccgctacctcccaccatcctccaaccctccagtctgacgatgaggctgagtatcagtggngganagagccaanacaattcgatacgggacctaaagggggtcggggtttggggtcggttacggggacggggaacgggacccaaggtcccgttcggaccccggttaccgtaacgggtcgaaccggccccgaaaggggtccccttcccggcccccccgttcgggttacccaccttcccgtttcccgttacccccaaccccttcccgtcggttacccttaacggttaacgtaaccg

SEQ ID NO: 347329 - DNA, 601 bp, Homo sapiens
  misc_feature: GZ8MTXP01ETDY3.15.86.H09.1.454.CMB.2.raw
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatagaaagttaagagtgatggcagccacaccgaagggggacggatccccgatcgcttcatgggctcagttcgtgggggctgaccgctacctccaccatccaccaacctccagtctgacgangaggctaggatatcatggngganagaancccaaanactaagtgagtacggaccgaagggggttcggggttggggtcggtacggggacggaacggaccgaggcgtacgtaccgtacgtacggacgaacgaccgaggcccgttcccggtccccgtcggttaccttccgttcccgttcccgtaccccctcccgttcccgtacggttaccgttaacggttaacgtccg

SEQ ID NO: 347330 - DNA, 539 bp, Homo sapiens
  misc_feature: GZ8MTXP01BKYXQ.15.86.H09.1.454.CMB.2.raw
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctccagttctggggctgaccgctacctcaccatctctaacctcagtctgacgatgaggctgagtatcactgtggagagagccacacaattgatggaccaaggggacgggttggggtgttcggggcggagggaccaaggctggaccgtccgtagggtcaacggccaaggcttcgccccctggttccncttctcgttccccaacctcncgctaacgttgaacg

SEQ ID NO: 347331 - DNA, 574 bp, Homo sapiens
  misc_feature: GZ8MTXP01CLZ2H.15.86.H09.1.454.CMB.2.raw
  modified_base (371)..(371): a, c, t, g, unknown or other
  misc_feature (371)..(371): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (476)..(476): a, c, t, g, unknown or other
  misc_feature (476)..(476): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttgggggaagaggaagactgacggtccccccaggagttcgggctgagcgtggtttcctgacgtgctatcttaaaggtgtccagtgtgaagtgcaggtggtggagtctgggggagccttggtaaagccgtggggggtcccttagagtctcctgtgtggcctctggattcactttcagtaatggctggatgagttgggtccgccaggctcgagggaaggggcgtggaggtgggtggtacgttactaaagtaaaatagatggtgagaaatagactacggtgcacccgtgaaaggaagattcaccatctcaagagaataattanaaaacgaacggtagtatttagtacaaatagaacagacctagaacgaagaacgacagccgtactatactatacacagatagagtagananagagaagagatatgtnttgtatagtcgtcggcgacggacgagtgtcgtcgtctctcnctccnccgaccgacgccgcgttccgtcctcccgtccgcctcccttcctccgaacgcg

SEQ ID NO: 347332 - DNA, 531 bp, Homo sapiens
  misc_feature: GZ8MTXP01DLIT6.15.86.H09.1.454.CMB.2.raw
  modified_base (446)..(446): a, c, t, g, unknown or other
  misc_feature (446)..(446): n is a, c, g, or t
  modified_base (498)..(498): a, c, t, g, unknown or other
  misc_feature (498)..(498): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagcacaccgaagggggacggatcccgatcgcttcatggctccagttctggggctgaccgctacctccaccatctccaacctccagtctgacgatgaggctgagtatcatggtggagagagccaatacaaattgatgggcccaaagggggtcgggtttggggtgttcgggngggagggaccaaggctgaccgtcagggtcaagccaaggcttcgcccctgccncttctcgtcccgcctccngcctaacgttgaacg

SEQ ID NO: 347333 - DNA, 536 bp, Homo sapiens
  misc_feature: GZ8MTXP01DKGWY.15.86.H09.1.454.CMB.2.raw
  modified_base (502)..(502): a, c, t, g, unknown or other
  misc_feature (502)..(502): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctgggggctgaccgctacctccaccatctccaacctccagtctgacgatgaggctgagtatcactgtggagagagccatacaaattgaatgggacccaaaggggacgggtttggggtgttcgggcggagggccaagctgaccgtctaggcaagcccaaggcttgcccctggttcncttctgttcccaaccctctcgctaacgttgaacg

SEQ ID NO: 347334 - DNA, 665 bp, Homo sapiens
  misc_feature: GZ8MTXP01A136Z.15.86.H09.1.454.CMB.2.raw
  modified_base (478)..(478): a, c, t, g, unknown or other
  misc_feature (478)..(478): n is a, c, g, or t
tcagtctacgtagccacgaccggtgctcgatttagtgctatagacttgggtttggggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtgggttgacgttcaaaagtaaaatgatggagaagaaatagactacggtgcaccgtgaaaggaagattcaccatctacaagagaataaattacaaaaaacgacggtagtatttagacaaatgaaacagaaccctagaaaccgagaacacacgccgtatattactgtaaccacagattcggaaatgacatcgaaacgtaaaggnggtactatgggtctttttagattagtcgtgggggccccaaggggaacctaagttcgggttcgtccggtctcttcgacgtccccttacccgaaacccgtaaacggggccccttaacgttcccgggttcccctttccccccgaacgggtcccctaacccccgttccccttaaccccaaagggtaacccg

SEQ ID NO: 347335 - DNA, 571 bp, Homo sapiens
  misc_feature: GZ8MTXP01EJNQL.15.86.H09.1.454.CMB.2.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (272)..(273): a, c, t, g, unknown or other
  misc_feature (272)..(273): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagacagggaactccccagtaatnaaatgaaagttaagangnngacacgacgacgacgaggacgacgccgncgctgngtcgcgtcgtgtcgtcggcgtcncgaccctacctactaccaccactccaccncctcacgtctgacgagtagagtntagagtagacgacgtaggagacgagacgacacgaactagtagagggtcggtacggtacggtacgggtacggtcggtacggacggacggacgtacgtacgtacgccgtaacgtacgacgaccgaccgaccgtccgttccgttcccgttccgtccgtccgtccgttccgtcccgttcccgtccgttcgtcg

SEQ ID NO: 347336 - DNA, 536 bp, Homo sapiens
  misc_feature: GZ8MTXP01EQD3X.15.86.H09.1.454.CMB.2.raw
  modified_base (406)..(406): a, c, t, g, unknown or other
  misc_feature (406)..(406): n is a, c, g, or t
  modified_base (493)..(493): a, c, t, g, unknown or other
  misc_feature (493)..(493): n is a, c, g, or t
  modified_base (504)..(504): a, c, t, g, unknown or other
  misc_feature (504)..(504): n is a, c, g, or t
  modified_base (523)..(523): a, c, t, g, unknown or other
  misc_feature (523)..(523): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctcagttctgggggctgaccgctacctccaccatctccaaccctccagtctgacgatgaggctgagtatcactgtggagagacgccaanacaaattgaatgggaccaaggggtacggggtttggggtcgttcgggcggagggaccaagctgaccgtctaggcaagcccaagggccncgcccctggcncttctcgttcccaacctcncgctaacgttgcg

SEQ ID NO: 347337 - DNA, 545 bp, Homo sapiens
  misc_feature: GZ8MTXP01AKN8A.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttggggacttccctggtctccttctacctactgcccttcatttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagctcgtggggctgaccgctacccctcacatctccaaacctccaagtctgacgatgaggctgagtatcatgtggagagagccanacaaattgaatgggaccgaaggtacggggtttggggtgttcgggcgggaggggaccaaggctggacccgtccgtagggtccaggccccaagggcctcgcccccttggttcactcctcgtccccgcctcttcgtcttaacgtg

SEQ ID NO: 347338 - DNA, 603 bp, Homo sapiens
  misc_feature: GZ8MTXP01EMCKC.15.86.H09.1.454.CMB.2.raw
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacggatccccgatcgcttcatgggctcagttctgggggctgacgctacctccaccatctccaacctccagtcngacgatgaggctgagtatcactgtggagagtagcccaaanactagtgatacggaccgaagggggtcggggttggggtcggtcggggacgggaacggaccgaaggccgtcggtacccgtcgtacggccaacgcccgaaggtcccttcccggcccccgttggttacccttccgttcccgttaacccgttcccccaaccccgtttcccgtaccggttaccgttaaccggttaacgtaacg

SEQ ID NO: 347339 - DNA, 629 bp, Homo sapiens
  misc_feature: GZ8MTXP01CEQAI.15.86.H09.1.454.CMB.2.raw
  modified_base (331)..(331): a, c, t, g, unknown or other
  misc_feature (331)..(331): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcagtgggctccagttcgngggggctgaccgctacctccaccatctccacctccagtctgacgatgaggctgagtatcaacgttgnggagagacgcccaaanactagttgagtcggaccgtaagggggtcggggttggggtcggtaccggggacgggaacgggacgaggtccgtacggtacccgtacgtacggtccgaacggcccgaaacgggtcccgttcccggccccccgttcgggttacccttcccgttcccgttaacccgttccccctaaccccgttcccgtaccgttaccgttaaccggttaacgtaaccgg

SEQ ID NO: 347340 - DNA, 673 bp, Homo sapiens
  misc_feature: GZ8MTXP01A5WDD.15.86.H09.1.454.CMB.2.raw
  modified_base (418)..(418): a, c, t, g, unknown or other
  misc_feature (418)..(418): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacgacgaagggggacggactccccgatcgcttcagtcgggctccgtagttcgtgggggctcgaccgctacctccaccatcctaccaacctccagtctgacgatgagctgatatcacgtggaggagagacgaccaanacaagttgagtaggaccgaaagggggtcggggtttggggtcggttaccggggacgggaacggggaaccccaaagggtccgtacggtaccccgggttaccgtaacgggtcccgaaccgggaccccgaaggggtccccttcccgggccccccccgtttacggggttacccttacccgtttccccggtttcccggttccccccccgtccccgtttccccgtcccgggttacccgttaaccgggttaacgggtaacccg

SEQ ID NO: 347341 - DNA, 522 bp, Homo sapiens
  misc_feature: GZ8MTXP01BKB09.15.86.H09.1.454.CMB.2.raw
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (491)..(491): a, c, t, g, unknown or other
  misc_feature (491)..(491): n is a, c, g, or t
  modified_base (509)..(509): a, c, t, g, unknown or other
  misc_feature (509)..(509): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtcagcatctgccttgctgggagcctcgatcaagctcacctgcaccctaagtagtgagcatcgaacctacaccatcgaatggtatcaacagagacagggaacgtcccccagtatataatagaaagtaagagtgatggcagccacaccgaaggggacggatccccgatcgcttcatgggctcagttcgtggggctcgaccgctacctccaccatcctccaacctccagtctgacgatgaggctgagtatcacgtgnggangacgccanacaattgatggaccaaggggtacgggttggggntcgggngagggacaagctgaccgtcaggtcaagccaggcttcgcccctggcncttctcgttcccgcctcncgctcgttgaacg

SEQ ID NO: 347342 - DNA, 599 bp, Homo sapiens
  misc_feature: GZ8MTXP01EW7ET.15.86.H09.1.454.CMB.2.raw
  modified_base (310)..(310): a, c, t, g, unknown or other
  misc_feature (310)..(310): n is a, c, g, or t
  modified_base (440)..(440): a, c, t, g, unknown or other
  misc_feature (440)..(440): n is a, c, g, or t
  modified_base (532)..(532): a, c, t, g, unknown or other
  misc_feature (532)..(532): n is a, c, g, or t
  modified_base (560)..(560): a, c, t, g, unknown or other
  misc_feature (560)..(560): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctggagtgggttggacgttcaaaagtaaaatgatggtnagaaaatagactacggtgcaccgtgaaaggaagattcaccatctcaagagaataaattacaaaaaacgacggtagtatttcgacaaaatgaaacagacctagaaaccgaggaacacagccgtctattacngtaaccacagattcggaagtgcaatcgaacgtaaaggaggactatggtacttttgatatcgtcggggcccagggacaagtgggtcgtcgtcnctttcagtcccttcgaccgaagggcccnttccggtcctcccccgtggcccacccttctaaccaagcg

SEQ ID NO: 347343 - DNA, 555 bp, Homo sapiens
  misc_feature: GZ8MTXP01EKR6W.15.86.H09.1.454.CMB.2.raw
  modified_base (387)..(387): a, c, t, g, unknown or other
  misc_feature (387)..(387): n is a, c, g, or t
  modified_base (520)..(520): a, c, t, g, unknown or other
  misc_feature (520)..(520): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacgggatccccgatcgcttcatgggctccagttctggggctgaccgctacctccaccatctcccaacctccagtctgacgatgagctgagtntcactggtggagagacgccaacacgaattcgattcgggacccaagggggtacggggtttggggtggttcggggcgggaggggacccaaggctggacccgtcgtagggcaagcccaaggccttcgcccctggcncttctcgttccccncctccncgctaacgttcgtcg

SEQ ID NO: 347344 - DNA, 517 bp, Homo sapiens
  misc_feature: GZ8MTXP01DN5DH.15.86.H09.1.454.CMB.2.raw
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagcacaccgaaggggacggatccccgatcgcttcatgggctcagttcgtggggctcgaccgcacctcaccatcctccaacctccagtctgacgatgaggctgagtatcactgnggagagacgcanacaattgatggaccaagggacgggttggggtgttcgggcggacggacaagctgaccgtctagcaagccaggcttcgcccctgcncttcgcgtcccnccctctcgctcgcgtcg

SEQ ID NO: 347345 - DNA, 596 bp, Homo sapiens
  misc_feature: GZ8MTXP01DFTUT.15.86.H09.1.454.CMB.2.raw
  modified_base (333)..(333): a, c, t, g, unknown or other
  misc_feature (333)..(333): n is a, c, g, or t
  modified_base (419)..(419): a, c, t, g, unknown or other
  misc_feature (419)..(419): n is a, c, g, or t
  modified_base (542)..(542): a, c, t, g, unknown or other
  misc_feature (542)..(542): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacacatcgaatggtatcaacagagaccagggaactcccccagtatataatagaaagttaagagtgatggcagaccacgaccgaagggggacggactccccgatcgcttcagtgggctcgagttcgnggggctcgaccgctacctcccaccatctacccaacctccagtctgacgatgagctagagtatcgacgtggtggaagagacgccaanacaattgaatcgggaccaaagggggtcggggtttaggggtcgtacgggcggagggaccaaggctacggacccgtcgagggtcaacgtcccgaagggtccttccggaccccccgttggttcccncgttccgttccggttcccccgcccttcccgtcgaccttaaccggttaagaaccg

SEQ ID NO: 347346 - DNA, 656 bp, Homo sapiens
  misc_feature: GZ8MTXP01DN0XM.15.86.H09.1.454.CMB.2.raw
  modified_base (410)..(410): a, c, t, g, unknown or other
  misc_feature (410)..(410): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccagttctgggggctgaccgctacctccaccatcctccaacctccagtctgacgatgaggctgagtatcactggtaggagagagccaanacaattgatcgggaccctaaagggggtaccggggtttggggtacgttccgggggacgggaacgggggacccaaaggccgttacgggaaccccggttcccgtaagggggtccaaacgggccccccgaaagggggtcccttccgggccccccccccgttggggttccccttaaccgtttcccttccggtttccccccccaacccctttcccgtacccggttaccttaacccgggttaacgtaacccgg

SEQ ID NO: 347347 - DNA, 605 bp, Homo sapiens
  misc_feature: GZ8MTXP01D1CLA.15.86.H09.1.454.CMB.2.raw
  modified_base (406)..(406): a, c, t, g, unknown or other
  misc_feature (406)..(406): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaaggggacggatccccgatcgcttcatgggctccgagttcgtggggctgaccgctacctccaccatctccaacctccagtctgacgatgaggctgagtatcactggtgagagagccaanacaaattgaattcggggacccaaagggggtaccgggtttggggtacgttacgggcgggaaggggacccaaaggtccgttggaaccccgttccgtaagggccaacggtccccaaaggggccttcggcccccccttgggttccaccctttcgtccgtttacccccaacccgttccgccgacttaaccggttaacgtaaccg

SEQ ID NO: 347348 - DNA, 529 bp, Homo sapiens
  misc_feature: GZ8MTXP01EJXXG.15.86.H09.1.454.CMB.2.raw
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (500)..(500): a, c, t, g, unknown or other
  misc_feature (500)..(500): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacgggatccccgatcgcttcatggctcagttctggggctgaccgctacctcaccatctccaacctccagtctgacgatgaggctgagtatcactgtgganagagccanacaattgatgggaccaaaggggtacgggtttggggtgttcgggcggagggacccaaggctgaccgtctaggtcaagcccaaggcttgccccctggcnttctgtccccncctcncgactaacgngcg

SEQ ID NO: 347349 - DNA, 557 bp, Homo sapiens
  misc_feature: GZ8MTXP01CRXNG.15.86.H09.1.454.CMB.2.raw
  modified_base (323)..(323): a, c, t, g, unknown or other
  misc_feature (323)..(323): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (507)..(507): a, c, t, g, unknown or other
  misc_feature (507)..(507): n is a, c, g, or t
tcagtctacgtagccacgaccggtgctcgatttagtgctatagacttgggtttggggggacttccctggtctccttctacctactgcccttcatttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacacgaagggggacggatccccgatcgctcatgggctcagttcnggggctgaccgctacctcaccatctccaacctcagtctgacgatgaggctgatatcatgnganaganccaananatgatacgacaaggggtcgggttggtcgtcgggacggaacggaccaggcctacggtacccgtcgaggccaacggacccgacgggtcccttccggtcccccgtggttcccncgttcccttccgttcccccaacccgttcgtcgaccgttaacgcggtaacg

SEQ ID NO: 347350 - DNA, 615 bp, Homo sapiens
  misc_feature: GZ8MTXP01EG2O9.15.86.H09.1.454.CMB.2.raw
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcatgggctccagtttcgtgggggctcgaccgctacctccaccatcctccaacctccagtctgacgatgaggctgagtatcagtgtgganagacgccaacanaaagttgaatcgggaccaaagggggacggggtttggggtcgttcggggacgggaacgggacccaaggtctcggtacccgtccgttagggccaaacggccccgaaaggggtccccttcggccccccccttgggttcccgaccttcccgttccggtttcccccccgccccttcccgtccggttaccttaacggttcgtaacg

SEQ ID NO: 347351 - DNA, 644 bp, Homo sapiens
  misc_feature: GZ8MTXP01ACBFP.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaaggggacggatccccgatcgcttcatggctccagttctggggctgaccgctacctccaccatcctcccaacctccagtctgacgatgaggctgagtatcactggtggagagacgaccaacacgtaattgaattcgggaccctaaagggggtaccggggtttgggggttcgttaccgggggaccgggaagggggaccccaaaggtcccgtaggtaaccccggttccgtaaggggtcccaacgggcccccgaaaggggtcccttaccggccccccccgttgggttccccttacccgttcccttcccggttcccccccccttcgtccggtcccttaaccggtcgaaccgttccgggg

SEQ ID NO: 347352 - DNA, 587 bp, Homo sapiens
  misc_feature: GZ8MTXP01D9RDR.15.86.H09.1.454.CMB.2.raw
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (506)..(506): a, c, t, g, unknown or other
  misc_feature (506)..(506): n is a, c, g, or t
  modified_base (545)..(545): a, c, t, g, unknown or other
  misc_feature (545)..(545): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctctgtgtggcctctggattcactttcagtaanggctggatgagttgggtccgcaggctccgaggagggctggagtgggtggacgtttanaaaagtaaatgagtggtagaagaaatagacgtacggtgacaccgtgaaagaagattacacatctacaagagtaataaagtacaaaaaacgtcggtagttattagacaaatgaaacagacctagggaaaacgaggacaacgagccgtatattaccagtacccanagtataacggaattggacagtacggaaccttaaaagggngttactaagtgtcttttagattacgtcgttcgggggaacccg

SEQ ID NO: 347353 - DNA, 618 bp, Homo sapiens
  misc_feature: GZ8MTXP01EQ2OF.15.86.H09.1.454.CMB.2.raw
  modified_base (578)..(578): a, c, t, g, unknown or other
  misc_feature (578)..(578): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggctgggagtggggttggacgtttacaaaagtaaaatgatggagaagaaaatagactacggtgcaccgtagaaaggaagattcaccatctacaagagaataaattacaaaaacgacggtagtatttagactaaatgaacagaacctagaaaccgaggacacagaccgtactattactgtacacgtagacttacggaaagtgacagtacgaacgtaaagggagtactatgggttacttttaggatagtcgtgggcccaggggactaagtgtcgtcgtcgtcttcacgccttaccgacgaacgggcccngttccggtccctccccgtgcccacccgttctccgaagccg

SEQ ID NO: 347354 - DNA, 547 bp, Homo sapiens
  misc_feature: GZ8MTXP01BYRLH.15.86.H09.1.454.CMB.2.raw
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggactccccgatcgcttcagtggctcagttcgtggggctgaccgctacctccaccatcctcccaaccctaccagtctgacgatgaggctgatatcacgtgnggagagacgccaanacaattgatgggaccaagggggtcgggtttggggtcgttcggggnggacgggaccaaggcctgacccgtctagggcaacgcccgaggccttcgccccctgccncttctcgtccccncctcncgctaacgttgcg

SEQ ID NO: 347355 - DNA, 531 bp, Homo sapiens
  misc_feature: GZ8MTXP01AXBPB.15.86.H09.1.454.CMB.2.raw
  modified_base (405)..(405): a, c, t, g, unknown or other
  misc_feature (405)..(405): n is a, c, g, or t
  modified_base (444)..(444): a, c, t, g, unknown or other
  misc_feature (444)..(444): n is a, c, g, or t
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacgggatccccgatcgcttcatgggctccagttcgtggggctgaccgctacctccaccatctccaacctcagtctgacgatgaggctgagtatcactgaggagagacgccanacaattgatggaccaaggggacgggttgggtgttcgggnggagggacaaggctgacccgtctaggcaagcccaggccttcgcccctggccncttctcgtccccaaccctcncgctaacgttgaacg

SEQ ID NO: 347356 - DNA, 586 bp, Homo sapiens
  misc_feature: GZ8MTXP01AXLVL.15.86.H09.1.454.CMB.2.raw
  modified_base (309)..(309): a, c, t, g, unknown or other
  misc_feature (309)..(309): n is a, c, g, or t
  modified_base (441)..(441): a, c, t, g, unknown or other
  misc_feature (441)..(441): n is a, c, g, or t
  modified_base (472)..(472): a, c, t, g, unknown or other
  misc_feature (472)..(472): n is a, c, g, or t
  modified_base (551)..(551): a, c, t, g, unknown or other
  misc_feature (551)..(551): n is a, c, g, or t
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgaatggtnagaaaatagactacggtgcaccgtgaaaggagattcaccatctcaagagaataattacaaaaacgcgtagtatttgacaaatgaacagacctagaaacccgaggacacagtaccgtctattactgtacccanagattcggaagtgacagtcgaacgtaaaggnggactagtggtcttttgatactcgtggggcccaggggaccaagtggtcgtcgtctcttcagcccttcaccgaaggcccnttccggtcttcccccgngccnccttccaacgaagc

SEQ ID NO: 347357 - DNA, 579 bp, Homo sapiens
  misc_feature: GZ8MTXP01B5MIE.15.86.H09.1.454.CMB.2.raw
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacaggacgtccccagtatataatagaaagtaagagtgatggcagaccacgacgaagggggacggactccccgatcgcttcagtggctcagttcgtgggctgaccgctacctccacatctccaacctcagtctgacgatgagctagagtatcatggngganaggacnccctaaananagtgagcggaacgaagggggtgggttgggtcggtacgggaggaacggactagcgtacgtacccgtacgtacggcaacggacccgaggtcccgttcccgtccccgtcgttacccttccgttcccgttcccgttccccctcccgtccgtaccggttacgttaacggaacgtcg

SEQ ID NO: 347358 - DNA, 600 bp, Homo sapiens
  misc_feature: GZ8MTXP01BQ1WV.15.86.H09.1.454.CMB.2.raw
  modified_base (274)..(274): a, c, t, g, unknown or other
  misc_feature (274)..(274): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatacgaacctacaccatcgaatggtatcaacagagacgagggaacgtccccagtatataatagaaagtaagagtganggcagccacgaccgaagggggacggactcccgatcgctcagtcgggctccgagttcgtggggctcgaccgctacctcccaccatcctacccaacctccagtctgacgagtgagctagatatcagtggagganagacgccaanacaattgataggaccgaaggggtcggggtttgggcgtcggggacggaagggacccaaggtccgtcggaacccgttccgtaagggccaacggaccccgaagggtcccttccgccccccgttagggcccttacgttccccgttccggttccccccgcctttcccgcgaccttaacggttcggaacg

SEQ ID NO: 347359 - DNA, 587 bp, Homo sapiens
  misc_feature: GZ8MTXP01AN9CF.15.86.H09.1.454.CMB.2.raw
  modified_base (463)..(463): a, c, t, g, unknown or other
  misc_feature (463)..(463): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctgggagtgggttggacgtttcaaagtaaaatgatggtgagaaatagactacggtgcaccgtgaaaggagatcaccatctcaagagataattacaaaacgacggtgtatttcgacaaatgaacagacctagaaaccgaggacacagccgtctattactgtaccacagattcggaagtgcatcgacgtaaaggnggctatggtcttttgatagtcgtggggcccaggggacaagtggtcgtcgtctcgttcagcccttccgaccgaacgggcccagttccggtccttcccccgtggcccaccccttcctccgaagccg

SEQ ID NO: 347360 - DNA, 628 bp, Homo sapiens
  misc_feature: GZ8MTXP01DDFBG.15.86.H09.1.454.CMB.2.raw
  modified_base (333)..(333): a, c, t, g, unknown or other
  misc_feature (333)..(333): n is a, c, g, or t
  modified_base (390)..(390): a, c, t, g, unknown or other
  misc_feature (390)..(390): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttagagtgatggcagccacgaccgaagggggacggactccccgatcgcttcagtggctcgagtttcgngggctcgaccgctacctccaccatcctccaacctccagtctgacgatgagctgatancacgtgtggagagacgaccaacgacaattcgagtcgggaccgtaagggggtacggggtttgggggtacggttcggggacggggaacgggaaccaaggccgtcggtacccggtccgtacgggtcaaccggaccccgaagggtcccttcccggccccccgttcgggttcccttacccgttccgttcccggtttccccccgccccgtttcccgtccggaccgtttaacgggcgtaaccggg

SEQ ID NO: 347361 - DNA, 553 bp, Homo sapiens
  misc_feature: GZ8MTXP01C6LOE.15.86.H09.1.454.CMB.2.raw
  modified_base (412)..(412): a, c, t, g, unknown or other
  misc_feature (412)..(412): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagaccacgaccgaagggggacggactccccgatcgcttcagtgggctccgagttcgtggggctgaccgctacctccaccatctccaacctccagtctgacgatgaggctgagtatcacgtgaggagagagaccanacaattgatcggaccaaaggggtacgggtttggggtagttcgggcggaagggaccaagctagaccgtcaggtcaagcccaaggccncgcccccgtgttccncttcctcgtccccaacctccgtcgactaacgttaagaacg

SEQ ID NO: 347362 - DNA, 515 bp, Homo sapiens
  misc_feature: GZ8MTXP01DP46G.15.86.H09.1.454.CMB.2.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtccgcatctgccttgctgggagcctcgatcaagctcacctgcaccctaagtagtgagcatcgaacctacaccatcgaatggtatcaacagagaccagggaacgtccccccagtaatataaatgaaagttaagagtaganggcagccaacaccgaaagggggacggatcccgatcgcttcatgggctccagttcgtgggggctgaccgctacctcaccccatctcccaacctccaagtctgacgatgaggctgagtatcatgngagngancananatnangacagcggggttgggngtggnggaggacagctgacgtcaggtcagcccaaggctcgccccgtgcacgttcncgttcccactcngcttagcgcgtgg

SEQ ID NO: 347363 - DNA, 548 bp, Homo sapiens
  misc_feature: GZ8MTXP01DPS77.15.86.H09.1.454.CMB.2.raw
  modified_base (322)..(322): a, c, t, g, unknown or other
  misc_feature (322)..(322): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaagtcccccagtatataatgaaagttaagagtgatgcagcacacgaaggggacggatccccgatcgcttcatggctccagttcgngggctgaccgctacctccaccatcctccaacctccatctgacgatgaggctgacgtatcactgngganagagccanacaattgaatggaccaaaggggcgggtttggggtgttcgggacggaacgggacccaagccttggaaccgtcccgtaagggccaacggcccaagggcttcgcccccgtggcnccttcgtcgttccccnccctctcgctaaccgttgaaccg

SEQ ID NO: 347364 - DNA, 547 bp, Homo sapiens
  misc_feature: GZ8MTXP01AG3MM.15.86.H09.1.454.CMB.2.raw
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (511)..(511): a, c, t, g, unknown or other
  misc_feature (511)..(511): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctcagttctggggctgaccgctacctccaccatctcccaacctccagtctgacgatgagctgagtatcactgtggganagagccanacaattgatggaccaaggggacgggttggggtgttcggggcggaggggacccaaggcctggtacccgtcgtaggtcaacggccccaagggccttcgcccctcggttcnccttctcgtccccaaccctcctcgcctaacgttgcg

SEQ ID NO: 347365 - DNA, 660 bp, Homo sapiens
  misc_feature: GZ8MTXP01A94IP.15.86.H09.1.454.CMB.2.raw
  modified_base (403)..(403): a, c, t, g, unknown or other
  misc_feature (403)..(403): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccaacgaccgaagggggacggactccccgatcgcttcagtcgggctccgagttcgtggggctcgaccgctacctcccaccatcctacccaaccctccagtctgacgagtgaggctagagttancacgtggaggaagagacgacccaagaactaagttcgaagttcgggaacccgtaaaggggggttaccgggggttttgggggtacggttaccgggggacggggaacggggtaacccgaaggtccgtacggtaccccggtccgttaagggcccaacggccccgaaagggtcccttccgggcccccccgttgggttccccacgttcccgttccggttccccccaacccctttccggccttaccgtaaccggttgaacccgg

SEQ ID NO: 347366 - DNA, 621 bp, Homo sapiens
  misc_feature: GZ8MTXP01AJL9Q.15.86.H09.1.454.CMB.2.raw
  modified_base (436)..(436): a, c, t, g, unknown or other
  misc_feature (436)..(436): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
tcagtctacgtagccacgaccggtgctcgatttagtgctatagacttgggtttggggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtggggttggacgtttacaaaagtaaaatgatggagaagaaaatagactacggtgcaccgtagaaaggagattcacatctcaagagataattacaaaaacgcggtagtatttcgacaaatgaaacagaacctagaaccgaggacacagccgtatattacngtaccacgagtattcggaagtgacagtacgaacgtaaaggngcttagnggtcttttgatagtcgtcggggcccagggacagtgggtcgtcgtctcttcgacgtcccttaccgaaccgaacggggccccttaggttcccggttcccttcccccgcggccctaccccttccctaaccgaaggaaccg

SEQ ID NO: 347367 - DNA, 605 bp, Homo sapiens
  misc_feature: GZ8MTXP01C9I3Q.15.86.H09.1.454.CMB.2.raw
  modified_base (328)..(328): a, c, t, g, unknown or other
  misc_feature (328)..(328): n is a, c, g, or t
  modified_base (401)..(401): a, c, t, g, unknown or other
  misc_feature (401)..(401): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttcnggggctgaccgctacctccaccatctccacctccatctgacgatgagctgagtatcactgtggagagagccanaacaattgatagggcccaaagggggtacggggtttggggtcgttcggggacgggacggggacccaaggccgtggtacccgtccgtagggtccaacggccccgaaagggtccttccggccccccgtgggttcccttaccgttccgttcccggtttaccccccaacccttccccgtccggttaccttaaccggttaacgtaacccg

SEQ ID NO: 347368 - DNA, 547 bp, Homo sapiens
  misc_feature: GZ8MTXP01BGK1M.15.86.H09.1.454.CMB.2.raw
  modified_base (412)..(412): a, c, t, g, unknown or other
  misc_feature (412)..(412): n is a, c, g, or t
  modified_base (511)..(511): a, c, t, g, unknown or other
  misc_feature (511)..(511): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcatgggctccagttcgtggggctgaccgctacctccaccatcctcccaacctccagtctgacgatgaggctgagtatcacgtgtggagagagccaanacaattgatgggaccaaggggcgggtttggggtgttcgggcggagggaccaaggctgacccgtcgagggcaagcccgaaggccttcgcccctggttccncttcctcgttcccccnccctctcgctaacgttcgcg

SEQ ID NO: 347369 - DNA, 606 bp, Homo sapiens
  misc_feature: GZ8MTXP01A32GD.15.86.H09.1.454.CMB.2.raw
  modified_base (411)..(411): a, c, t, g, unknown or other
  misc_feature (411)..(411): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggactccccgatcgcttcatgggctccgagttcgtggggctgaccgctacctccaccatcctccaacctccagtctgacgatgaggctgagtatcactgtggagagacgccaanacaagttgatgggaccaagggggtacggggtttggggtacggttcgggacgggtaacgggacccaaggcctggaccccgttcgtaacggggtcaacggccccgaaagggcccttcggcccccccgttgggttccccacgttcccttcccggttacccccaaccccttcccgtccggaccttaaccggttaagccg

SEQ ID NO: 347370 - DNA, 536 bp, Homo sapiens
  misc_feature: GZ8MTXP01AJXL0.15.86.H09.1.454.CMB.2.raw
  modified_base (415)..(415): a, c, t, g, unknown or other
  misc_feature (415)..(415): n is a, c, g, or t
  modified_base (481)..(481): a, c, t, g, unknown or other
  misc_feature (481)..(481): n is a, c, g, or t
  modified_base (505)..(505): a, c, t, g, unknown or other
  misc_feature (505)..(505): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggactccccgatcgcttcatgggctccagttcgtgggggctgaccgctacctccaccatctcccaacctccagtctgacgatgaggctgacgtatcagtggtgggagagagcctaanacaattgatggaccaaaggggcgggttggggtgtcgggcggagggccaagctggaccgtcaggtcngcccaggcttcgcccctggttccncttctctccccgcctcncgctaacgngaacg

SEQ ID NO: 347371 - DNA, 535 bp, Homo sapiens
  misc_feature: GZ8MTXP01CHZ1Q.15.86.H09.1.454.CMB.2.raw
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
  modified_base (502)..(502): a, c, t, g, unknown or other
  misc_feature (502)..(502): n is a, c, g, or t
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
tcagtctacgtagccacgaccggtgctcgatttagtgctatagacttgggtttggggggacttccctggtctccttctacctactgcccttcattttctccacaggcctctgtgctctgcctgtgctgactcagcccccgtctgcatctgccttgctgggagcctcgatcaagctcacctgcaccctaagtagtgagcatcgaacctacaccatcgaatggtatacaacagagaccagggaactcccccagtatataatagaaagttaagagtgatggcagaccaacgaccgaagggggacggatccccgatcgcttcagtgggctccgagttcgtggggctgaccgctacctccaccatctacccaacctccagtctgacgatgaggctgagtancatgagagagagcanacaattgatggacaaggggtacggttgggtgtcgggacggaggaccaagcgtcgaccgtcgtaggcaacgccaaggccttcgcccctggcncgttctcgttcccccncctctcgctaacgngcg

SEQ ID NO: 347372 - DNA, 542 bp, Homo sapiens
  misc_feature: GZ8MTXP01AXSJS.15.86.H09.1.454.CMB.2.raw
  modified_base (413)..(413): a, c, t, g, unknown or other
  misc_feature (413)..(413): n is a, c, g, or t
  modified_base (507)..(507): a, c, t, g, unknown or other
  misc_feature (507)..(507): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatggggctccgagttcgtgggggctgaccgctacctccaccatcctcccaacctccagtctgacgatgaggctgagtatcactggtggagagagccaanacaattgatggccaagggtacggggttggggtcgtcgggcggagggaccaggctgaccgtctaggcaacgcccaggcttcgccccctggttccncttctcgttccccaaccctcctcgctaacgttgcg

SEQ ID NO: 347373 - DNA, 640 bp, Homo sapiens
  misc_feature: GZ8MTXP01EBLM2.15.86.H09.1.454.CMB.2.raw
  modified_base (383)..(383): a, c, t, g, unknown or other
  misc_feature (383)..(383): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccaacgaccgaaggggggacgggactccccgatcgcttcagtggctcgtagttcgtgggggctgaccgctacctcccaccatcctccaaccctccagtcngacgatgagctgatatcagtgtaggagagacgccaacgacaagttgaagtcggaccgaaagggggtacggggtttgggggtcgttaccgggggacggggaagggaacccgaaaggtcccgtacggtaccccgttaccgttagggcccaacggaccccgaaaggggtcccttccgggcccccttcgggttaccttaccggttccttcccgtaccccctaaccctcccgtccgttacgttaaccggttaacgtaaccgg

SEQ ID NO: 347374 - DNA, 531 bp, Homo sapiens
  misc_feature: GZ8MTXP01A4TVL.15.86.H09.1.454.CMB.2.raw
  modified_base (405)..(405): a, c, t, g, unknown or other
  misc_feature (405)..(405): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctcagttctggggctgaccgctacctccaccatcctccaacctccagtctgacgatgaggctgagtatcactggtggagagagccanacaattgatgggaccaaaggggcgggttgggtgttcgggcggagggaccaaggctgacccgtctagggtcngccccaaggccttgccccctggccncttctcgtcccnccctctgctgttcgaacg

SEQ ID NO: 347375 - DNA, 559 bp, Homo sapiens
  misc_feature: GZ8MTXP01BYOOC.15.86.H09.1.454.CMB.2.raw
  modified_base (355)..(355): a, c, t, g, unknown or other
  misc_feature (355)..(355): n is a, c, g, or t
  modified_base (407)..(407): a, c, t, g, unknown or other
  misc_feature (407)..(407): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacggatccccggatcgcttcatgggctcagttctgggggctgaccgctacctccaccatcnccaacctccagtctgacgatgaggctgagtatcactgtggagagagcccaanactaagttgagtcgggaccgaagggggtcggggttggggtcggttacgggacgggaggaccaagcgtcggacccgtcgtaggcaacgcccgaggtccttccgcccccgtgccncttccgtccgtccccgccctccgtcgctaacgttgaacg

SEQ ID NO: 347376 - DNA, 536 bp, Homo sapiens
  misc_feature: GZ8MTXP01CXLGY.15.86.H09.1.454.CMB.2.raw
  modified_base (331)..(331): a, c, t, g, unknown or other
  misc_feature (331)..(331): n is a, c, g, or t
  modified_base (410)..(410): a, c, t, g, unknown or other
  misc_feature (410)..(410): n is a, c, g, or t
  modified_base (449)..(449): a, c, t, g, unknown or other
  misc_feature (449)..(449): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggacagccacgaccgaagggggacggactccccgatcgcttcatgggctcagttcgnggggctcgaccgctacctccaccatcctccaaccctccagtctgacgatgagctgagtatcagtgtggagagagaccanacaattgatggaccaaggggtacggttggggtgtcgggnggaggacaagctgaccgtctacgcaacgccgaggcttcgccccgtgttccncttctcgttccccncctccgcgactaacgttgaacg

SEQ ID NO: 347377 - DNA, 676 bp, Homo sapiens
  misc_feature: GZ8MTXP01BH4AT.15.86.H09.1.454.CMB.2.raw
  modified_base (408)..(408): a, c, t, g, unknown or other
  misc_feature (408)..(408): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacaccgaagggggacggatccccgatcgcttcatgggctcgagttcgtgggctgaccgctacctccaccatcctccacctccacgtctgacgatgaggctgagtatcagtggtggagagacgccaanactaaagttcgaatcggggacccaaaggggggtcggggtttgggggtacgttccgggggacggggtaacggggacccaaaggtcccgttcgggaaaccccggttcccgttaaagggggcccaaacgggacccccgttaaagggggtccccttcccgggtcccccccccgttaggggttccccttaaccggtttccccgttcccgggtttcccccccccggccctttttccccgccggttacccgttaaaccgggtttcggaacccggg

SEQ ID NO: 347378 - DNA, 530 bp, Homo sapiens
  misc_feature: GZ8MTXP01DT7TU.15.86.H09.1.454.CMB.2.raw
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccaacgaccgaagggggacggacnccccgatcgcttcagtcggctcgagttcgtggggctcgaccgctacctccaccatctaccaacctccagtcagacgatgagctagagtatcagtgaggagagacgaccanacaattgagtggaccaaggggtcgggttggtgtcggaggaggacaagctgacccgtcgagtcaacgccgaggccttcgcccctgccncttctcgtcccncctcncnctaacgngcg

SEQ ID NO: 347379 - DNA, 566 bp, Homo sapiens
  misc_feature: GZ8MTXP01EPQCO.15.86.H09.1.454.CMB.2.raw
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (491)..(491): a, c, t, g, unknown or other
  misc_feature (491)..(491): n is a, c, g, or t
  modified_base (524)..(524): a, c, t, g, unknown or other
  misc_feature (524)..(524): n is a, c, g, or t
tcagtctacgtagccacgaccggtgctcgatttagtgctatagacttgggtttgggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggactccccgatcgcttcagtggctccgagttcgtggggctcgaccgctacctcccaccactcctacccacctccagtctgacgatggagctgagtancgactggagganagacgccaanaacattcgatcgggaccaagggggtacgggtttggggtcgtcgggagggaggaccaggctggtacccgtcnggccaacgccagggccttaccgccccgttggcncttcgtccgtccccaaccttccgcgttactaacggttgaacg

SEQ ID NO: 347380 - DNA, 534 bp, Homo sapiens
  misc_feature: GZ8MTXP01AE5KP.15.86.H09.1.454.CMB.2.raw
  modified_base (409)..(409): a, c, t, g, unknown or other
  misc_feature (409)..(409): n is a, c, g, or t
  modified_base (499)..(499): a, c, t, g, unknown or other
  misc_feature (499)..(499): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcatgggctccagttcgtggggctgaccgctacctccaccatcctccaacctccagtctgacgatgaggctgagtatcactggtggagagagccanacaattgatggcaaggggcggttgggtgtcgggcggagggaccaagctgccgtctagggtcaagcccaagggccttcgcccccctggccncttctcgttccccgccctccncggctaacgttgcg

SEQ ID NO: 347381 - DNA, 687 bp, Homo sapiens
  misc_feature: GZ8MTXP01DT5VL.15.86.H09.1.454.CMB.2.raw
  modified_base (228)..(228): a, c, t, g, unknown or other
  misc_feature (228)..(228): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaanagagaccagggaacgtccccagtatataatagaaagttagagtgatggcagccacgaccgaagggggacggactccccgatcgctcagtgggctccgagttcgtggggctcgaccgctacctccaccactcctaccaccctccagtctgacgagtgaggctgagtatcacgtggnggagaagtacgaccaanactaattggaagtcgggaccctaaaggggggtcggggttttgggggtacgggttaccggggacggggaacggggtaaacccgaaaggtccgttacgggtaaccccggttaccggtaacggggttccgaaacccgggtcccccgaaaggggtccccgttacccgggtcccccccccgttaggggttaccccttccggtttccccgtttcccgggttccccccctcccgtttccccggtcgttacccgttaaacggttaacgaaccggg

SEQ ID NO: 347382 - DNA, 612 bp, Homo sapiens
  misc_feature: GZ8MTXP01EL3F4.15.86.H09.1.454.CMB.2.raw
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttgacgtttacaaaagtaaaatgatggtagagaaaatagactacggtgcaccgtgaaaggagattcaccatctacaagagaataaattacaaaaacgacggtagtatttgacaaatgaacagacctagaaaccgagacacagccgtntattactgtaccanagattcggaatacatacgacgtaaaggagactatgtcgttttagattatcgtagggggccccaggggacaagtcggtcgtcgtctcgttcaacgccctccgaccgtaacggggccccagttccgggttcccttcccccgtggccctacccctcccttaccaacgcgtccc

SEQ ID NO: 347383 - DNA, 542 bp, Homo sapiens
  misc_feature: GZ8MTXP01B7PO8.15.86.H09.1.454.CMB.2.raw
  modified_base (407)..(407): a, c, t, g, unknown or other
  misc_feature (407)..(407): n is a, c, g, or t
  modified_base (506)..(506): a, c, t, g, unknown or other
  misc_feature (506)..(506): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttctgggggctgaccgctacctccaccatcctccaaccctccagtctgacgatgaggctgagtatcactgtggagagagccanacaagttgatggccaaggggtacggttggggtgttcgggcggagggaccaaggctgtaccgtctagggcaacgcccaagggccttgccccctggttccncgttctgttccccaacctccncgctaacgttgaacg

SEQ ID NO: 347384 - DNA, 557 bp, Homo sapiens
  misc_feature: GZ8MTXP01B1KKT.15.86.H09.1.454.CMB.2.raw
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccgagttcgtgggggctgaccgctacctcccaccatcctacccaacctcccagtctgacgatgaggctggagtatcgacgtggtaggagagacgccaacacaattgatggccaaggggtcgggttggggtcgttcgggcggagggaccgaaggcctcggtaccgtccgtaggtccaacgcccgttaaggccttcgccccctggttcncgttctcgtcccncctcncgctcgttgcg

SEQ ID NO: 347385 - DNA, 654 bp, Homo sapiens
  misc_feature: GZ8MTXP01CWG3U.15.86.H09.1.454.CMB.2.raw
  modified_base (279)..(279): a, c, t, g, unknown or other
  misc_feature (279)..(279): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtggggagccgttggtaagccgtggggtcctagagtctctgtgtgctctgatcacttcagtangctggatgagtggccgcgaggctccgagggagggcgtggagtgggttggacgtttagaaaagtaaatgatggtagaagaaatgacgtacggtgaaccaccgtgaaaggagacttacaccatcacaagagaataaattacgaaaaacgtacggtagttaatttagaacaaagtagaaacagaaccgtaaaggggaaaacccggagggaaccaacgacgtacccgttacttaactttaaccgtacgtaacccaacgtaagtaacgttaaccgggaaagttcgtacgaaacgtaccgggaaacggttaaaagggacggttacttaaaggttcggttaacgtttttaggaagtttacgtccgggttcgggggaaccccg

SEQ ID NO: 347386 - DNA, 530 bp, Homo sapiens
  misc_feature: GZ8MTXP01BVZHD.15.86.H09.1.454.CMB.2.raw
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagacagggaacgtccccagtatataatagaaagttaagagtgatggcagaccacgaccgaagggggacggatccccgatcgctcagtggctcgagttcgtgggggctcgaccgctacctccaccatcctacccaacctccagtctgacgatgagctgatancactggnggagagacgccaanacattgatggacagggtcggttgggtgtcggnggaggaccagcgtgaccgtccgtaggcaacgcccgaaggtccncgccccctggcncgttctcgtccccncctcncgcctaacgngcg

SEQ ID NO: 347387 - DNA, 652 bp, Homo sapiens
  misc_feature: GZ8MTXP01CPWN0.15.86.H09.1.454.CMB.2.raw
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
  modified_base (645)..(645): a, c, t, g, unknown or other
  misc_feature (645)..(645): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacacatcgaatgtatacaacagagacgaggacgtccccagtatataatagaaagtaagagtgatgacagccacgaccgaaggggacggactcccgatcgctcagtcggctcgagttcgtgggcgtcgaccgacctacctacccaccactcctacccaaccctaccacgtctacgacgagtagaggcgtagacgtanccgaagtggngggaagagaccgacccaaanacgtaaagttgacgttacgggaacccgtaagggggtaccgggggtttgggggtacgtccggggacgggaacgggaacccaagtcgtcggtaaccccgtccgtaagggtcaaccgcccgaacgggtccttcccgggacccccccgttggttccacccgtttccgttaacccggttaccccccaaccctttccccgaggttaccttaacccgggnggtaacg

SEQ ID NO: 347388 - DNA, 582 bp, Homo sapiens
  misc_feature: GZ8MTXP01CTS9D.15.86.H09.1.454.CMB.2.raw
  modified_base (564)..(564): a, c, t, g, unknown or other
  misc_feature (564)..(564): n is a, c, g, or t
tcagtctacgtagccacgaccggtgctcgatttagtgctatagacttgggtttgggggaagaggaagactgacggtcccccaggagttcgggctgagctgggtttccttgctgctatcttaaaggtgtccagtgtgaagtgcaggtggtggagtctgggggagccttggtaaagcctggggggtcccttagagtctcctgtgtggcctctggattcactttcagtaatggctggatgagttggtccgccaggctccagggaaggggctggagtgggttggacgtttcaaaagtaaaatgatggtagagaaaatagactacggtgacacccgtgaaaggagattcaccatctcaagagaataattacaaaaacgacggtgtatttgacaaatgaacagacctagaaaccgaggacacagccgtctattactgtacacagatacggaagtagacatacgacgtaaaggaggacgtatggtctttgtatagtcgtcgggccgaggacgagtggtcgtcgtctctcacgtccttccgaccacggccgcttcgtcctaacccctcgccncccttcctccaacgaacg

SEQ ID NO: 347389 - DNA, 533 bp, Homo sapiens
  misc_feature: GZ8MTXP01D3SL8.15.86.H09.1.454.CMB.2.raw
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcatgggctccgagttcgtgggggctgaccgctacctccaccatctccaacctccagtcngacgatgaggctgagtancatggnggagagacgccaacacaattgattgggaccaaagggggtacgggttggggtgttcgggcgggagggaccaagctgaccgtctaggcaagcccaggcncgcccctggcncttctcgtcccaacctcngctaacgttgcg

SEQ ID NO: 347390 - DNA, 645 bp, Homo sapiens
  misc_feature: GZ8MTXP01DMMFQ.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatcaacagagaccgagggaacgtcccccaagtataataatagaaagttaagagtgatggcagaccaacgaaccggaagggggacggactccccgatccgcttcagtcgggctcgtagttcgtggggctcgaccgctacctccacctactcctacccaacctccagtctgacgatgagtctgagtatcacgtggtaggagaagacgaccaacaacgaagttcgagtacgggacccgtaagggggtacggggtttggggtcggttccggggagggaacggaccgaaggccgtacggtacccgtcgtagggtccaacgggccccgaagggtcccttccgggtccccccgtgggttacccttccttcccgttcccgttaccccccaacccgtttccgtaccggttaccgttaaccggaacgtccgg

SEQ ID NO: 347391 - DNA, 533 bp, Homo sapiens
  misc_feature: GZ8MTXP01B7JP1.15.86.H09.1.454.CMB.2.raw
  modified_base (404)..(404): a, c, t, g, unknown or other
  misc_feature (404)..(404): n is a, c, g, or t
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatggctccagttctgggggctgaccgctacctccaccatctccaacctccagtctgacgatgaggctgagtatcactgtggagagagccanacaattgatggaccaaggggtcggttggggtgtcgggcggagggaccaagctgccgtcgtaggtcaacgcccaggccttcgccccctggttccncttctcgttccccncccttccncgctaacgttgcg

SEQ ID NO: 347392 - DNA, 568 bp, Homo sapiens
  misc_feature: GZ8MTXP01ENEU0.15.86.H09.1.454.CMB.2.raw
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatggctcagttctgggggctgaccgctacctccaccatctctaaccctccagtctgacgatgagctgagtatcactgnggagagagcccaaananatgagtcgacgaaggggtcgggttgggtcgtacgggaggacggacgagcgtacgtaccgtcgtaggcaacgccgaggtcccttccggcccccgtcggttccttccgttccgttcccgttccccnccccgttccgtccgttaccgtaacggttaacgcg

SEQ ID NO: 347393 - DNA, 564 bp, Homo sapiens
  misc_feature: GZ8MTXP01EWU5H.15.86.H09.1.454.CMB.2.raw
  modified_base (526)..(526): a, c, t, g, unknown or other
  misc_feature (526)..(526): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccaatcgcttcatgggctcagttcgtggggctgaccgctacctccaccatctcccaaccctccagtctgacgatgagctgagtatcacgtggtggagagacgcctaacacaaagttgaatcgggaccaaaggggtacggggtttggggtacgttcggggacgggaggaccctaagcgtcgacccgtcagggtcaacggcccaaggccttcgccccctggttcnccgttctcgttccccaacccttcncgctaacgttcgcg

SEQ ID NO: 347394 - DNA, 554 bp, Homo sapiens
  misc_feature: GZ8MTXP01ET7VB.15.86.H09.1.454.CMB.2.raw
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (509)..(509): a, c, t, g, unknown or other
  misc_feature (509)..(509): n is a, c, g, or t
  modified_base (553)..(553): a, c, t, g, unknown or other
  misc_feature (553)..(553): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgganccccgatcgcttcagtgggctccagttctgggggctgaccgctacctccaccatctccaaccctccagtctgacgatgaggctgagtatcactgtggagagganccctaaananaatgagtggacaagggggtcgggttgggtcgtcgggaggaggaccagcgtcgaccgtcgtaggcaacgcccgagccttccggccccgtggttccnccttccgtccgtccccgtccctccgtccgactaacggttaacgng

SEQ ID NO: 347395 - DNA, 603 bp, Homo sapiens
  misc_feature: GZ8MTXP01DKNPU.15.86.H09.1.454.CMB.2.raw
  modified_base (409)..(409): a, c, t, g, unknown or other
  misc_feature (409)..(409): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacaccgaagggggacggatccccgatcgcttcatgggctcagttctgggggctgaccgctacctccaccatctccaacctccagtctgacgatgaggctgagtactcactggtggagagagtccaanacaattgaatgggaccaaaggggtacggggtttggggtgttcggggcgggaggggacccaaaggcgtacgacccgttccgtaagggtcaacggccccaaagggtccttcggacccccccttggggttcccaccttcccgttcggttacccccccaacccttcccgtccgaccgttaacccggttaagtaacccg

SEQ ID NO: 347396 - DNA, 604 bp, Homo sapiens
  misc_feature: GZ8MTXP01A2QIV.15.86.H09.1.454.CMB.2.raw
  modified_base (430)..(430): a, c, t, g, unknown or other
  misc_feature (430)..(430): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtccccagtatataatgaaagttaagagtgatggcagaccacgaccgaagggggacggactccccgatcgcttcagtgggctccgagttcgtggggctcgaccgctacctcccacctactcctacccaacctccagtctacgacgactgaggtctgtagtatccgtagtggagggacgagaacgccaanactaagttgagtacgggacctaaagggggtcgggttggggtacgtcgggacggaggaccaaggctcggaccgttcgaggtcaacgcccgaagggcccttccgtcccccgtggttcccaccgttccgttaaccgttcccccaacccgttcccgtacggcctaacggttcgtaacg

SEQ ID NO: 347397 - DNA, 533 bp, Homo sapiens
  misc_feature: GZ8MTXP01BOMV5.15.86.H09.1.454.CMB.2.raw
  modified_base (447)..(447): a, c, t, g, unknown or other
  misc_feature (447)..(447): n is a, c, g, or t
  modified_base (499)..(499): a, c, t, g, unknown or other
  misc_feature (499)..(499): n is a, c, g, or t
  modified_base (519)..(519): a, c, t, g, unknown or other
  misc_feature (519)..(519): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccgaagggggacggatccccgatcgcttcatgggctcagttcgtggggctgaccgctacctccaccatcctcccaacctccagtctgacgatgagctgagtatcactgtggagagacgccacacaattgatggaccaaggggtcgggttggggtgtcgggnggagggaccaaggctgaccgtctaggtcaagcccaggcttcgccccctggcncttcgtcgtccccgcctccncgctcgttgtaacg

SEQ ID NO: 347398 - DNA, 579 bp, Homo sapiens
  misc_feature: GZ8MTXP01ECKZY.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagttctgggggctgaccgctacctccaccatctccaacctccagtctgacgatgaggctgagtatcacgtgtggagagagccaacacaattgaatggacccaaaggggacgggtttggggtagttcggggacggaaggggacccaaaggctaggtacccgtccgtagggtcaaggccccaaaggggccttacgcccccgtagggttccacttccgttctcccccaaccttccctcgttcctaacggttaacgaaccg

SEQ ID NO: 347399 - DNA, 632 bp, Homo sapiens
  misc_feature: GZ8MTXP01APHSS.15.86.H09.1.454.CMB.2.raw
  modified_base (567)..(567): a, c, t, g, unknown or other
  misc_feature (567)..(567): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacgaccgaagggggacggactccccgatcgcttcagtgggctcagttcgtggggctcgaccgctacctcccaccatcctacccacctccagtctgacgatgaggctgagtatcacgtggtggagagacgccaacacaagttgagtcgggacccgaaaggggggtcggggtttaggggtcggttcggggacgggtacggggaaccctaaggccgttcggtaccccggtcgtaacgggtccaacggtccccgaaagggtcccttccggcccccccgttgggttcccnccgtttcccgttccggttcccccgccccttcccgtcgttacccgttaacgggttaacgtaaccgg

SEQ ID NO: 347400 - DNA, 533 bp, Homo sapiens
  misc_feature: GZ8MTXP01BON3F.15.86.H09.1.454.CMB.2.raw
  modified_base (404)..(404): a, c, t, g, unknown or other
  misc_feature (404)..(404): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttggggacttccctggtctccttctacctactgcccttcatttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctgggggctgaccgctacctccaccatcctccaacctccagtctgacgatgaggctgagtatcactgtggagagacgccanacaattgatgggacccaagggggcgggtttggggtgttcgggcggagggaccaggctgaccgtctaggcaagcccaaggccttgccccctggttcncttctcgttccccgcctcctcgctaacgttgcg

SEQ ID NO: 347401 - DNA, 593 bp, Homo sapiens
  misc_feature: GZ8MTXP01AZX0O.15.86.H09.1.454.CMB.2.raw
  modified_base (424)..(424): a, c, t, g, unknown or other
  misc_feature (424)..(424): n is a, c, g, or t
  modified_base (545)..(545): a, c, t, g, unknown or other
  misc_feature (545)..(545): n is a, c, g, or t
  modified_base (563)..(563): a, c, t, g, unknown or other
  misc_feature (563)..(563): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgaccgaagggggacggactccccgatcgcttcagtggctccgagttcgtggggctcgaccgctacctcccaccactcctcccaaccctccacgtctgacgagtgaggctgatatcagtggtaggaagagacgacccaanaactaattgagtggacccgaagggggtcggggtttggggtcgtcgggcggacggaccaaggcgtcggaccgttccgaggtccaacggtcccgagggcccttccggcccccgtgggttcccncgttcgtccgttcccccnccccttcgtccgactaacggttcgtaacgg

SEQ ID NO: 347402 - DNA, 635 bp, Homo sapiens
  misc_feature: GZ8MTXP01EGI9Z.15.86.H09.1.454.CMB.2.raw
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacgaccgaagggggacggatccccgatcgcttcagtgggctccagttcgtgggggctcgaccgctacctccaccactctcccaacctccagtctgacgatgaggctgagtatcatgngganagagccaanacaattgatgggaccaagggggtacggggtttggggtacgtcgggggacggaacgggaccaaggtcctacgggtaacccgttccgttaggggccaacggacccgaaaggggtcccttccggcccccccgttaaggggttcccttaccctttcccgttaacccggtttcccccaacccctttcccgtacggttaccgttaaaccgggttaacgtaacccggg

SEQ ID NO: 347403 - DNA, 714 bp, Homo sapiens
  misc_feature: GZ8MTXP01CXEF0.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagtaagagtgatggcagaccacgaccgaagggggacggactccccgatcgcttcagtgggctccgagttcgtggggctcgaccgctacctccaccatcctaccaaccctccagtctagacgatgaggctagagtatcgacgtggtagggaagaacggaacacccaaactaactaaagtttggaaacgttcggggaaacccgtaaaggggggttaccgggggtttgggggttacgggttaccgggggaacggggtaacgggggaaccctaaagggtccgtacgggtaaccccgttaccgtaacgggggtcaaccgggacccccgaaaggggtccccttcccggtaccccccccgttggggttaccccttaaccgttccccgttcccggtttacccccccaaccccgtttccccgtacggttacccgttaaaccgggttaacggtaacccggg

SEQ ID NO: 347404 - DNA, 598 bp, Homo sapiens
  misc_feature: GZ8MTXP01A4L2S.15.86.H09.1.454.CMB.2.raw
  modified_base (304)..(304): a, c, t, g, unknown or other
  misc_feature (304)..(304): n is a, c, g, or t
  modified_base (573)..(573): a, c, t, g, unknown or other
  misc_feature (573)..(573): n is a, c, g, or t
tcagtctacgtagccacgaccggtgctcgatttagtgctatagacttgggtttgggggaagaggaagactgacggtcccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaagggctggagtggggttgacgttcaaagtaaatgatggngagaaatagactacggtgcaccgtagaaaggagattcacatctacaagagataattacaaaaacgacgtgtatttgacaaatgaacagacctagaaaccgaggacacagccgtactattactgtaccacagatacggaagtgcatcggaacgtaaaggaggtactaagtgggtacttttagactagtcgtcgggggcccaggggacaagtggtcgtcgtctcttcagtcccttccaccgtaacgggccccattcccggtcctcccccgnggcccacccttccctccgaaggccg

SEQ ID NO: 347405 - DNA, 639 bp, Homo sapiens
  misc_feature: GZ8MTXP01AWUPJ.15.86.H09.1.454.CMB.2.raw
  modified_base (307)..(307): a, c, t, g, unknown or other
  misc_feature (307)..(307): n is a, c, g, or t
  modified_base (404)..(404): a, c, t, g, unknown or other
  misc_feature (404)..(404): n is a, c, g, or t
  modified_base (428)..(428): a, c, t, g, unknown or other
  misc_feature (428)..(428): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtccccagtatataatagaaagttaagagtgatggcacgaccacgaaccggaagggggacgggacnccccgatcgcttcagtcgggctccgtagttcgtgggactcgaccgctacctccaccactcctacccaacctccacgtctgacgagtgagctgagtancagtggtaggaagagacgaccaanactaattgaatcgggaccaaagggggtcggggtttggggtcggtaccgggcgggtaacgggaccgaaggtccgtcggacccggttcgtacggtccgaaacggccccgaaaggtccccgttccggaccccccttgggttacccttaccgttccgttaaccgtttccccccaacccgttcccgtacgttaccttaaccggttaacgtaaccgg

SEQ ID NO: 347406 - DNA, 629 bp, Homo sapiens
  misc_feature: GZ8MTXP01DFC5B.15.86.H09.1.454.CMB.2.raw
  modified_base (399)..(399): a, c, t, g, unknown or other
  misc_feature (399)..(399): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaaccctaagtagtgagcatacgaacctacacatacgaatggtatacaacagagacgaagggaacgtccccaagtataataaatagaaagttaagagtagagtgacagaccaacgaaccggaaggggacggactaccccgactcgcttcagtgggctacctagttcgtcgggggctacgaccgctacctcccaaccatcctaccaacctaccgagtcngagatagaggctagatactacaggtgacgggaagacgacgacaataacaagtgaagtcggaaacgtaagggggttacggggttggggtcggacgggaacggaacggaaccaagttccgtacggtaccgtacgtaggccaacggacccgttaggtcccncccgtccccggttcgacttcccgttccttcccgttaccccaacccttgtacgttaccgttaacgaagtaacg

SEQ ID NO: 347407 - DNA, 597 bp, Homo sapiens
  misc_feature: GZ8MTXP01CBN20.15.86.H09.1.454.CMB.2.raw
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccaacgaccgaaggggggacggatccccgatcgcttcagtgggctccgagttcgtggggctcgaccgctacctcccaccatcctcccaacctccagtctgacgatgaggctgagtncacgtgnggagagacgccaanacaattgatggaccagggggtacgggttgggggtcgtcggggacggtaggacccgaaggtcctcggaacccgttcgtaaggccgaacggtccccgaagggcccttaccggtccccccgttggttacccttcttccgttcccgtccccgtccctccgccgttcttaaccggttgaaccgg

SEQ ID NO: 347408 - DNA, 611 bp, Homo sapiens
  misc_feature: GZ8MTXP01EMNCC.15.86.H09.1.454.CMB.2.raw
  modified_base (302)..(302): a, c, t, g, unknown or other
  misc_feature (302)..(302): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactcccccagtatataatagaaagttaagagtgatggcagccacgacgaagggggacggacnccccgatcgcttcatgggctcgagttcgtgggctcgaccgctacctcccaccactcctacccaaccctaaccctacgtcgtcgacgacgtagaggcgtgagtatcactggtggagagaacgaccaacaacaagttgagtacggaccgaaaggggtacggggtttggggtgttccggggacgggagggaaccagcgtcgaccgtacccgtggcgaacgaccccgaagggccttccggcccccccgttgggttccaccttccgttccgttaccccaaccccttccgtcgaccgttaacgttaacgaaccgg

SEQ ID NO: 347409 - DNA, 653 bp, Homo sapiens
  misc_feature: GZ8MTXP01BZOGD.15.86.H09.1.454.CMB.2.raw
  modified_base (229)..(229): a, c, t, g, unknown or other
  misc_feature (229)..(229): n is a, c, g, or t
  modified_base (351)..(351): a, c, t, g, unknown or other
  misc_feature (351)..(351): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (597)..(597): a, c, t, g, unknown or other
  misc_feature (597)..(597): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatacaanagagaccgagggaacgtcccccagtataataatagaaagttaagagtgatggcagccacgaccgaagggggacggactccccgatcgctcagtggctcgagttcgtgggctgaccgctaccnccaccactcctacccaacctccacgtcgtagacgagtggaggtcgtagagtactcacgtggnggaagaggaacnccaacaacgtaaagttcgaattcgggaacccgtaaagggggtacggggttttggggttcgggtaccggggaggggaacggggaacctaaaggccgtcggtaaccccggttacgtaacgggtcgaacgggtaccccgaaaggggtcccttccggaccccccgttgggttaccnccgttcccgtccgttcccccgtaacctccccgtcgaccgttaacggttcgaaccgg

SEQ ID NO: 347410 - DNA, 755 bp, Homo sapiens
  misc_feature: GZ8MTXP01DIW7G.15.86.H09.1.454.CMB.2.raw
  modified_base (338)..(338): a, c, t, g, unknown or other
  misc_feature (338)..(338): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagaccacgaaccgaagggggacggactccccgatcgctcagtcgggctccgtagttcgnggggctcgaccgctacctccaccactcctaccaacctccagtctgacgatgagctgagtactcacgtggtaggagagacgacccaataactaagttacgagttacggggaacccgaaaggggggttccgggggtttgggggttacgggttaccggggggacgggggtaaaccggggtaacccgaaaaggggtcccgttacgggtaacccccgggtttaccggtaacggggttcccgaaaccggggacccccgttaaaacgggggtccccttccccggggtacccccccccccggtttgggggttaacccccttccccgtttaccccggtttccccgggtttacccccccccgtaacccccttttcccccggtacccgggttacccgtttaacccgggttaaccggttaaccccgggg

SEQ ID NO: 347411 - DNA, 648 bp, Homo sapiens
  misc_feature: GZ8MTXP01CKL0E.15.86.H09.1.454.CMB.2.raw
  modified_base (410)..(410): a, c, t, g, unknown or other
  misc_feature (410)..(410): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgctcatgggctccagttcgtggggctgaccgctacctcccaccatctcccaacctccagtctgacgatgaggctgagtatcaacgtgtaggagagagccaanacaaagttgaagtcgggaccctaaagggggtccggggtttaggggtcggttccggggacgggggaaggggacccaaagggcctcgggtaaccccgttccgtaaacggggtcccaacgggtcccccaaagggggccccttccgggccccccccgttggggttacccacccgttccgttcccgggttccccccgtccccttccccgtcgggacccctttaacgggttaacggtaacccgg

SEQ ID NO: 347412 - DNA, 601 bp, Homo sapiens
  misc_feature: GZ8MTXP01AG9RN.15.86.H09.1.454.CMB.2.raw
  modified_base (405)..(405): a, c, t, g, unknown or other
  misc_feature (405)..(405): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctaggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttcgtggggctgaccgctacctccaccatctcccaacctccagtctgacgatgagctgagtatcatgtggagagagccanacaattgatcggaccaaagggggacgggtttggggtcgttcggggacgggaggggaaccaaggtccgtcggtacccgtccgtaaggggtccaacggcccccgaaaggggcccttccgggtccccccctgggttcccacgttcccgttccggttcccccgaaccccttccgtccggccttaaccggttaacgaaccg

SEQ ID NO: 347413 - DNA, 659 bp, Homo sapiens
  misc_feature: GZ8MTXP01BKHR0.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatgtatacaacagagacgagggaacgtccccagtatataatagaaagtaagagtgatggcagccacgacggaaggggacggactcccgatcgctcagtggctcgagttcgtgggctcgaccgctacctccacctactcctacccaaccctccagtctgacgatggagcgtagatatcagtggaggaagagacgaccaagactaagttgagtacgggaccgtaagggggtcggggtttgggggtcgttaccgggggacgggaacggggacccaaggtcccgtacggtaaccccgttccgtagggtccgaaccggaccccgaaaggggtccccttccgggacccccccgtttgggttccccttacccgtttcccgttcccggttacccccccaaccccgtttcccgtaccggttaccgtttaacccgggttaaggtaacccgg

SEQ ID NO: 347414 - DNA, 585 bp, Homo sapiens
  misc_feature: GZ8MTXP01BO05G.15.86.H09.1.454.CMB.2.raw
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccagggaacgtcccccagtatataatgaaagtaagagtgatggcagccacaccgaaggggacggactcccgatcgcttcagtggctcagttcgtgggctgaccgctacctccaccatcctccaacctccagtctagacgatcgaggctagatatcagtgngganagacgtccaatanaattgatcgggaccaaagggggtcgggtttggggtcgttacggggacggacggggacccaaggtccgtgtaaccccgtccgtaaggggccaacggccccaaagggccttccggcccccccgtggttccacgttcccgtcttcccccaaccctttccgcggaccttaacgcggaaccg

SEQ ID NO: 347415 - DNA, 586 bp, Homo sapiens
  misc_feature: GZ8MTXP01EG5BA.15.86.H09.1.454.CMB.2.raw
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (543)..(543): a, c, t, g, unknown or other
  misc_feature (543)..(543): n is a, c, g, or t
  modified_base (563)..(563): a, c, t, g, unknown or other
  misc_feature (563)..(563): n is a, c, g, or t
  modified_base (582)..(582): a, c, t, g, unknown or other
  misc_feature (582)..(582): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatacgaacctacaccatcgaatggtatcaacagagaccgaagggaacgtccccagtatataatagaaagttaagagtgatggcagcacgacggaagggggacggactcccgatcgcttcagtgggctcgagttcgnggggctcgaccgctacctcccaccatcctaccaaccctccagtcgtagacgatgaggctgagttancagtggagganagacgcaacaataatgaagtcggaacctaaggggggtcggggtttgggtacgtcgggacggaagggaccaaggcgtcgtacccgttcgacgggtcaacggcccgagggcccttccggccccctggttcccncttccgttccggttcccccnccctcgtccgactaacggngtcg

SEQ ID NO: 347416 - DNA, 562 bp, Homo sapiens
  misc_feature: GZ8MTXP01BXOVX.15.86.H09.1.454.CMB.2.raw
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatagaaagttaagagtgatggcagccacgacgaagggggacggatccccgatcgcttcagtggctcagttcgtggggctgaccgctacctccaccatcctccaacctccagtctgacgatgaggctgagtatcactggnggagagagccanacaattgaatggaccaaaggggtcgggtttggggtcgttcgggacgggacgggaaccaaggcgtgaacccggttctagggtcaacggccccgaagggccttcgcccccgtggccacttccgtcgtccccgcccttcgcgcctaacggttgaacg

SEQ ID NO: 347417 - DNA, 666 bp, Homo sapiens
  misc_feature: GZ8MTXP01B61O5.15.86.H09.1.454.CMB.2.raw
  modified_base (339)..(339): a, c, t, g, unknown or other
  misc_feature (339)..(339): n is a, c, g, or t
  modified_base (444)..(444): a, c, t, g, unknown or other
  misc_feature (444)..(444): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgcgtgggagcctcgatcaagctcacctgcaccctaagtagtgagcatcgaacctacaccatcgaatggtatacaacagagaccgagggaacgtccccagtatataatagaaagttaagagtgatggcagaccaacgaccggaagggggacggactccccgatcgctcagtggctcgtagttcgngggctcgaccgcctacctcccaccactcctacccaaccctccagtcgacgacgagtcggaggcgtagagttactcaacggtgggaggaagaagaacgacccaaanaacgtaaagttggaagttcgggaaccccgtaaaggggggtacggggtttggggtacgtccggggacgggaacgggacccaggtccgtcggtacccgtcgtagggccaacggccccgaagggtcccttcccgggaccccccgttgggttaccttcccgtttccgtcccgggtttcccccctaacccttccccggtcgttacccgttaacggttaacgggcccg

SEQ ID NO: 347418 - DNA, 652 bp, Homo sapiens
  misc_feature: GZ8MTXP01ERI11.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacaccatcgaatggtatacaacagagaccgagggaacgtccccagtataataatagaaagttaagagtgatggcagaccacgaccggaagggggacggactccccgatcgcttcgagtcgggctccgtaggtttcgtgggggctcgaccgtcctacctcccaccactcctacccaaccctcccagtctagacgagtggaggtctgagttatcgaacgttggacgggagaagacgaccaacaactaagttcgaagtacgggaccgtaaagggggtcggggtttggggtcgtcggggacgggaggaccaggcctcggtacccgtcgtaggcaacggacccgaggggtcccttccgggcccccgttcgggttacccttccgttcccgttcccgggtttcccccccgcccgttcccgtaccggttccgttaacgggttcggtaaccgg

SEQ ID NO: 347419 - DNA, 681 bp, Homo sapiens
  misc_feature: GZ8MTXP01DEVUP.15.86.H09.1.454.CMB.2.raw
  modified_base (439)..(439): a, c, t, g, unknown or other
  misc_feature (439)..(439): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccagtatataatagaaagttaagagtgatggcagccacgaaccgaagggggacggactccccgatcgcttcagtcgggctccgtagtttcgtgggggctcgaccgctacctccaccactcctacccaaccctcccacgtctgacgagtaggaggctagagttactcacgttgggaggagaagacgacccaaanaacgtaagttgacgtagggaaccccgtaaagggggttcgggggtttggggtacggttaccgggggacgggaacggggacccaaaggtccgtacggtacccgtcgtaggggaccaacgggccccgttaaaggggtcccttcccggtccccccgttgggttacccttaccgttcccgtttccccgggttccccccaaccccgtttcccgtacccggttaccgttaaccggttaacgtaaccggg

SEQ ID NO: 347420 - DNA, 600 bp, Homo sapiens
  misc_feature: GZ8MTXP01A41FS.15.86.H09.1.454.CMB.2.raw
  modified_base (345)..(345): a, c, t, g, unknown or other
  misc_feature (345)..(345): n is a, c, g, or t
  modified_base (455)..(455): a, c, t, g, unknown or other
  misc_feature (455)..(455): n is a, c, g, or t
  modified_base (489)..(489): a, c, t, g, unknown or other
  misc_feature (489)..(489): n is a, c, g, or t
  modified_base (594)..(594): a, c, t, g, unknown or other
  misc_feature (594)..(594): n is a, c, g, or t
  modified_base (597)..(597): a, c, t, g, unknown or other
  misc_feature (597)..(597): n is a, c, g, or t
  modified_base (599)..(600): a, c, t, g, unknown or other
  misc_feature (599)..(600): n is a, c, g, or t
tcagtctacgtagccacgaccggtgctcgatttagtgctatagacttgggtttggggggaagaggaagactgacggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtagaaaggaagattcaccatctcaaagagaataattacaaaaacgacggtgtatttgacaaatgaacagcctagaaaaccgaggacacagccgtctattactgtaccacagattcggaagtncagtcgaacgtaaaggagctatgtctttgatacgtcgtggggcccagggacaaagtggtcgtcgtctcttcagccctcaccgacggccctagtccggtcccttcccccgnggccctacccctcctaccaacgcgccacctcggnggggggcacgacggccggcccgtgggcctcggccgtggtacgaaacggtacctaccgttccgcgttacggtagacgtggacggcggggcttgggaacaggcgcanagngnn

SEQ ID NO: 347421 - DNA, 597 bp, Homo sapiens
  misc_feature: GZ8MTXP01D3MH4.15.86.H09.1.454.CMB.2.raw
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtggggttggacgtttacaaaagtaaaatgaatggtagaagaaaatagactacggtgcacccgtgaaaaggaagattcaccatctacaagagaataaattacaaaaacgacggtgtatttgacaaatgaacagacctagaaccgagacacacgcgtctatacngtacanagattcggaagtgcagtaccgaagtaaaggaggactagtggtctttgtatatcgtcgggccgacggacgaagtaggtcgtcgtctctcttcgtccttccaccaacggcccgcttccgtccttcccctccgccacccttccctccaacgaacg

SEQ ID NO: 347422 - DNA, 633 bp, Homo sapiens
  misc_feature: GZ8MTXP01CMM4X.15.86.H09.1.454.CMB.2.raw
  modified_base (333)..(333): a, c, t, g, unknown or other
  misc_feature (333)..(333): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctgggagtggggttggacgtttcaaaagtaaaatgatggtagaagaaaatagactacggtncaccgtagaaaggaagattcaccatctacaagagaataaattacaaaaacgacggtgtatttcgacaaatgaacagaacctagaaaccgaggaacacgagccgtctattactcgtaccacagattcggaagtgcagtcgaacgtaaaggaggctaagtggtctttttagacttagtcgtggggacccagggacagtgggtctcgtctcgttcacgtcccttccgaaccgagggccccagttcccgggttccccttccccccgtggacccctaccccgttccgtaacccgaaacggtcccg

SEQ ID NO: 347423 - DNA, 634 bp, Homo sapiens
  misc_feature: GZ8MTXP01BX2E1.15.86.H09.1.454.CMB.2.raw
  modified_base (441)..(441): a, c, t, g, unknown or other
  misc_feature (441)..(441): n is a, c, g, or t
  modified_base (481)..(481): a, c, t, g, unknown or other
  misc_feature (481)..(481): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaggggctggagtggggttggacgtttacaaaagtaaaatgatggagaagaaaatagactacggtgcaccgtagaaaggagattcaccatctacaagagaataattacaaaaacgacggtagtatttcgacaaatgaacagacctagaaacccgaggacacagccgtactattacngtaaccacagattcggaagtgacagtacgaacgtaaaggnggtactagttggtctttttaggattagtcgtcgggggcccaggggactaagtgggtcgtcgtctcttcgacgtcccttccgaaccgaacggggccccttagttcccgggtcccttccccccgtggcccctaccccttccgtaaccaaggcccg

SEQ ID NO: 347424 - DNA, 668 bp, Homo sapiens
  misc_feature: GZ8MTXP01C524C.15.86.H09.1.454.CMB.2.raw
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatcgaacctacacatcgaatggtatacaacagagacgagggaacgtccccagtatataatagaaagtagagtgatggcagaccacgaccggaagggggacggactccccgatcgcttcagtggctcgagttcgnggggctcgaccgctacctcccaccatcctacccaacctccagtcgagacgagtggaggctagagtatcagtggtaggaanagacgccaanacgtaattcggaagtcgggaacctaaaggggggtccggggtttggggtacggttaccggggacgggtaacggggaaccctaaagggtccgttacgggaaccccgttacggtacggggtacccaaccgggtacccccgaaaggggtcccttaccggtcccccccgttgggttacccttaccgttcccgttcccgggttacccccgcccttcccggtacgttacccgttaaccgggttaacgtccgg

SEQ ID NO: 347425 - DNA, 535 bp, Homo sapiens
  misc_feature: GZ8MTXP01EMBYA.15.86.H09.1.454.CMB.2.raw
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (496)..(496): a, c, t, g, unknown or other
  misc_feature (496)..(496): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacacgaagggggacggatccccgatcgcttcatgggctcagttctggggctgaccgctacctccaccatctccaacctccagtctgacgatgagcngagtatcatgngganagganccaananagtgagtagacaaggggtggttgggtcgtcgggaggacggacaggctacgtccgtcgtaggcaacgaccgaggccttccgccccgtgttccncttctcctccccnccgtccncgttactaacgttcgaacg

SEQ ID NO: 347426 - DNA, 656 bp, Homo sapiens
  misc_feature: GZ8MTXP01EHE0I.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcacgcccccgtctgcatctgccttgctgggagcctcgatcaagctcacctgcaccctaagtagtgagcatacgaacctacaccatacgaatggtatcaacagagaccgagggaacgtccccagtatataatagaaagttaagagtgagtggcagaccacgaaccggaagggggacggacgtcccgatcgtcttcagtgggctcgtagttcgtggggctcgaccgctacctcccaccactcctacccaccctaccagtcgtgacgatgaggctagtatactcgacgttgggagggaagacggacgtacccaaacaactaaagttgaagtacggaccgtaaagggggtacggggtttggggttcggtacgggacggggaacggacccaaggtccgtacggtacccgtaccgtacgggccaacggccccgaaagggtcccttcccggcccccgttggttcccttaccgtttcccgtcccggtttccccccgcccgttcccgtccggttaaaccgttccggaacgtccg

SEQ ID NO: 347427 - DNA, 638 bp, Homo sapiens
  misc_feature: GZ8MTXP01BSD7G.15.86.H09.1.454.CMB.2.raw
  modified_base (422)..(422): a, c, t, g, unknown or other
  misc_feature (422)..(422): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaactcccccagtatataatgaaagttaagagtgatggcagccacaccgaagggggacggatccccgatcgcttcagtgggctcagttcgtgggactgaccgctacctcccaccatcctcccaaccctcccagtctagacgagtgaggctagacgtatacacgtggtagggagagacgaccaanacaattgaatcgggaacccaaagggggtccggggtttgggggttcgttaccgggggacgggacgggggaaccaaaggccgtacggacccggttccgtacgggtccaaccgggccccttaaaggggcccttcgggtccccccccgttgggttcccaccttcccgtcccggttacccccaacccttcccgcgttacccttaaccggttgtaacccggg

SEQ ID NO: 347428 - DNA, 595 bp, Homo sapiens
  misc_feature: GZ8MTXP01DI3LO.15.86.H09.1.454.CMB.2.raw
  modified_base (335)..(335): a, c, t, g, unknown or other
  misc_feature (335)..(335): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagacagggaacgtcccccagtatataatagaaagttaagagtgatggacagaccacgaccggaagggggacggactccccgatcgcttcagtggctcgagttcgngggctcgaccgctacctccaccatcctaccacctccagtctgacgagtgagctgagtatcacgtggnggaagagacgcccaanacaagttgagtacgggaccaaagggggtcggggttggggtcgtacggggacggacgggaccaagcgtcgacccgtcgagggccaacgcccgagggtcccnccggtccccctgggttaccttaccgttccttaacccgtcccccaacccgttccacggacttaacggttaagtaaccg

SEQ ID NO: 347429 - DNA, 529 bp, Homo sapiens
  misc_feature: GZ8MTXP01C1HAE.15.86.H09.1.454.CMB.2.raw
  modified_base (406)..(406): a, c, t, g, unknown or other
  misc_feature (406)..(406): n is a, c, g, or t
  modified_base (497)..(497): a, c, t, g, unknown or other
  misc_feature (497)..(497): n is a, c, g, or t
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
tcagtctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacggatccccgatcgcttcatgggctccagtttctgggggctgaccgctacctccaccatctccaaccctccagtctgacgatgaggctgagtatcactgtggagagagccanacaattgatggaccaaggggacgggttggggtgttcgggcggagggaccagctgaccgtctaggcaagcccaaggccttgccccctggccncttctgttcccccnccgtcctgcctcgngtcg

SEQ ID NO: 347430 - DNA, 585 bp, Homo sapiens
  misc_feature: GZ8MTXP01B1CN0.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatagaaagttaagagtgatggcagccacaccgaagggggacggatccccgatcgcttcagtgggctccagttcgtggggctgaccgctacctccaccatcctcccaacctccacgtctgacgatgaggctgagtatcactggtggagagagccacacaattgatgggaccaagggggtacgggtttggggtgttcgggcgggaagggaccaaggctcggacccgtcgtagggcaacggcccgaagggtccttccgccccccgtgggttccttccgttccgttccgtttcccccgcccttccgtccgccgttaaccggttcgtaaccg

SEQ ID NO: 347431 - DNA, 532 bp, Homo sapiens
  misc_feature: GZ8MTXP01AU58P.15.86.H09.1.454.CMB.2.raw
  modified_base (397)..(397): a, c, t, g, unknown or other
  misc_feature (397)..(397): n is a, c, g, or t
  modified_base (438)..(438): a, c, t, g, unknown or other
  misc_feature (438)..(438): n is a, c, g, or t
  modified_base (475)..(475): a, c, t, g, unknown or other
  misc_feature (475)..(475): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacacgaagggggacggatccccgatcgcttcatgggctccagttcgtgggggctgaccgctacctccaccatctcccaacctccagtctgacgatcgaggctgagtatcacttggnggagagagccacacaattgatggaccaaggggcggttgggngttcgggcggagggaccagcctgacccgtcctaggcngcccaaggccttcgcccctcggcacttctcgttcccccncctccncgctaacgngcg

SEQ ID NO: 347432 - DNA, 641 bp, Homo sapiens
  misc_feature: GZ8MTXP01BDIK2.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtatataatgaaagttaagagtgatggcagccacaccgaagggggacggatccccgatcgcttcagtggctccgagtttcgtgggggctcgaccgctacctccaccatcctaccaccctccagtctgacgatgaggctgagtatcacgtggtggagagacgacccaacaacgaaagtttgaagttcgggacccgtaaagggggtacggggtttgggggtcggttaccggggcgggaaggggacccaaaggccgttacgggaacccgttccgtagggtcccaacgggaccccgaagggtcccttcccggccccccgttcggttcccttaccgttcccgttaaccgttccccccaacccgttcccgttaccgccgttaacgttaacggaaccg

SEQ ID NO: 347433 - DNA, 623 bp, Homo sapiens
  misc_feature: GZ8MTXP01C3HYT.15.86.H09.1.454.CMB.2.raw
  modified_base (292)..(292): a, c, t, g, unknown or other
  misc_feature (292)..(292): n is a, c, g, or t
  modified_base (442)..(442): a, c, t, g, unknown or other
  misc_feature (442)..(442): n is a, c, g, or t
  modified_base (474)..(474): a, c, t, g, unknown or other
  misc_feature (474)..(474): n is a, c, g, or t
tcagtctacgtagccacgaccggtgctcgatttagtgctatagacttgggtttggggggaagaggaagactgacggtccccccaggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggagggctggagtgggttggacgttanaaaagtaaaatgatggagaagaaatagactacggtgacaccgtagaaaggagattcaccatctacaagagaataattacaaaaacgacggtgtatttcgacaaatgaacagaacctagaaaccgagacacagccgtatatactgtaccanagtattcggaatgacagtacgaacgtaaaggngactagtggtcttttagattacgtcggtcggggacccgagggactagtcggtccgtcgtctcttcacgtcccaccgaaccgaacgggcccttacgttcccggttccccttccccgtcgcccctaccccgttcctaaccgaacgaacccg

SEQ ID NO: 347434 - DNA, 646 bp, Homo sapiens
  misc_feature: GZ8MTXP01B18IV.15.86.H09.1.454.CMB.2.raw
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacggatccccgatcgcttcatgggctccagttctgggggctgaccgctacctcaccatctcccaacctccatctgacgatgaggctgagtatcacgtggtggagagacgccacacaattcgattcggggaccaaagggggtacggggtttggggtacggttccgggacggggaacgggggacccaaagggtccgtacggtaccccggttaccgtaagggtccaaacggtccccgaaaggggtccccttcggacccccccgttcggggttcccacccgtttccgttcccggttaccccccgaacccctttccccgtacgggttacccttaacccgggttaacggtaacccgg

SEQ ID NO: 347435 - DNA, 689 bp, Homo sapiens
  misc_feature: GZ8MTXP01AXAHJ.15.86.H09.1.454.CMB.2.raw
  modified_base (227)..(227): a, c, t, g, unknown or other
  misc_feature (227)..(227): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgccaaccctaagtagtgagcactaccgaacctacacatacgagtgtanacaacgagacgacgaacggtaccctacccagtataatagtaagtaaagtaagagtagagtcgacgacgaccaacgaacgggaacgggggacgtaccgtacccgtagtccgtcgtacaggtcgggtcctacggtacggtttcgggtcgggtcgtaccgaccgtacctaccctacccacctactccctaaccctaccctacctacgtcgacgaacgtagtacggacggtcgtaggtaactctaccgtaggtgggaaggacgaaggacccacaaactaagtaagtacgaggtccgggaaacggtaaacggggggttgggggtttggggtccggtacggggagggaacggacaggtcgacgtcccgtagtcggacgaaccgaaccgcggtcccttccccggtcccgtcgttaccttcttccccgttccgtaccccctccgttcgccgttacgttaacggcgtcggg

SEQ ID NO: 347436 - DNA, 652 bp, Homo sapiens
  misc_feature: GZ8MTXP01A5HFG.15.86.H09.1.454.CMB.2.raw
  modified_base (380)..(380): a, c, t, g, unknown or other
  misc_feature (380)..(380): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagccccgtctgcatctgccttgctgggagcctcgatcaagctcacctgcaccctaagtagtgagcatcgaacctacaccatcgaatggtatcaacagagaccgagggaactccccagtatataatagaaagttaagagtgatggcagccacgaccgaagggggacggacgtccccgatcgcttcgagtcggctccagttcgtggggctgaccgctacctcccaccactcctacccaaccctcacgtcngacgatggagctgagtatcacgtggaggagacgacgacctaacagtaaagttgaagttcgggaacccgtaaggggggtacggggtttagggggtcggttacggggaccggggaacggggaaccctaaggccggttacggacccggttacccgtaaggggtaccaacgggccccgttaaaggggccccttccggtccccccgtcgggttacccttccgttccgttaaccgttcccccaaccctttcccggacgttactaaccgggttcgaacg

SEQ ID NO: 347437 - DNA, 672 bp, Homo sapiens
  misc_feature: GZ8MTXP01EB24Q.15.86.H09.1.454.CMB.2.raw
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtcccccagtataataatagaaagttaagagtgatggcagaccacgaccgaagggggacggactccccgatcgcttcatgggctccgagttcgtgggggctcgaccgcctacctccacctatcctcccaaccctaccagtctgacgatgagctgatancgatggngagagacgccaanacaagttcgaagtgggaccaaagggggtacggggtttgggggtacggttaccggggacgggaaagggacccaaagggtcccttacgggaaaccccgttccgtaacggggttccaaacggtcccccgaaaggggtcccttcccgggtaacccccccgttcggggttcccaaccctttccccgttccgggtttacccccccccgtcccgttacccggtaccggttaacccgttaaccgggttaacggtaaccgg
